US012150960B2

(12) United States Patent
Xiao et al.

(10) Patent No.: US 12,150,960 B2
(45) Date of Patent: Nov. 26, 2024

(54) MODIFIED CELL EXPANSION AND USES THEREOF

(71) Applicants: Innovative Cellular Therapeutics Holdings, Ltd., George Town (KY); Innovative Cellular Therapeutics, Inc., Rockville, MD (US)

(72) Inventors: Lei Xiao, Rockville, MD (US); Zhiyuan Cao, Shanghai (CN); Chengfei Pu, Shanghai (CN); He Sun, Shanghai (CN)

(73) Assignees: Innovative Cellular Therapeutics Holdings, Ltd., George Town (KY); Innovative Cellular Therapeutics, Inc., Rockville, MD (US)

( * ) Notice: Subject to any disclaimer, the term of this patent is extended or adjusted under 35 U.S.C. 154(b) by 627 days.

(21) Appl. No.: 17/108,076

(22) Filed: Dec. 1, 2020

(65) Prior Publication Data
US 2021/0077532 A1 Mar. 18, 2021

Related U.S. Application Data

(63) Continuation of application No. 16/387,166, filed on Apr. 17, 2019, now Pat. No. 10,869,888, which is a continuation-in-part of application No. 16/146,218, filed on Sep. 28, 2018, now Pat. No. 10,561,686.

(60) Provisional application No. 62/817,322, filed on Mar. 12, 2019, provisional application No. 62/816,497, filed on Mar. 11, 2019, provisional application No. 62/799,462, filed on Jan. 31, 2019, provisional application No. 62/790,783, filed on Jan. 10, 2019, provisional application No. 62/721,791, filed on Aug. 23, 2018, provisional application No. 62/690,892, filed on Jun. 27, 2018, provisional application No. 62/687,059, filed on Jun. 19, 2018, provisional application No. 62/678,836, filed on May 31, 2018, provisional application No. 62/659,233, filed on Apr. 18, 2018, provisional application No. 62/659,114, filed on Apr. 17, 2018.

(51) Int. Cl.
| A61K 35/17 | (2015.01) |
| A61K 38/19 | (2006.01) |
| A61K 38/20 | (2006.01) |
| A61P 35/00 | (2006.01) |
| C07K 14/725 | (2006.01) |
| C07K 14/82 | (2006.01) |
| C07K 16/28 | (2006.01) |
| C12N 15/86 | (2006.01) |

(52) U.S. Cl.
CPC ............ *A61K 35/17* (2013.01); *A61K 38/191* (2013.01); *A61K 38/204* (2013.01); *A61K 38/208* (2013.01); *A61P 35/00* (2018.01); *C07K 14/7051* (2013.01); *C07K 14/82* (2013.01); *C07K 16/2818* (2013.01); *C12N 15/86* (2013.01)

(58) Field of Classification Search
CPC .... A61K 35/17; A61K 38/191; A61K 38/204; A61K 38/208; A61K 39/001102; A61K 2039/5156; A61K 2039/5158; A61K 39/001112; A61K 39/00117; A61P 35/00; C07K 14/7051; C07K 14/82; C07K 16/2818; C07K 2317/622; C12N 15/86
See application file for complete search history.

(56) References Cited

U.S. PATENT DOCUMENTS

| 9,388,237 B2 | 7/2016 | Govindan |
| 9,572,837 B2 | 2/2017 | Wu |
| 9,932,405 B2 | 4/2018 | Xiao et al. |
| 10,561,686 B2 | 2/2020 | Xiao et al. |
| 10,869,888 B2 | 12/2020 | Xiao et al. |
| 2002/0052027 A1 | 5/2002 | Chen et al. |
| 2002/0192183 A1 | 12/2002 | Jensen |
| 2005/0079170 A1 | 4/2005 | Le Gall et al. |
| 2013/0108609 A1 | 5/2013 | Vihko |
| 2013/0287748 A1 | 10/2013 | June et al. |
| 2014/0050708 A1 | 2/2014 | Powell et al. |
| 2014/0227237 A1 | 8/2014 | June et al. |
| 2014/0271635 A1 | 9/2014 | Brogdon et al. |
| 2015/0037356 A1 | 2/2015 | Elvin et al. |
| 2015/0038684 A1 | 2/2015 | Jensen |

(Continued)

FOREIGN PATENT DOCUMENTS

| JP | 2016500659 A1 | 1/2016 |
| JP | 2018528774 A | 10/2018 |

(Continued)

OTHER PUBLICATIONS

Wu et al. (Nanoscale Research Letters, 9(447): 1-11, 2014).*

(Continued)

*Primary Examiner* — Nelson B Moseley, II
(74) *Attorney, Agent, or Firm* — Lee & Hayes, P.C.

(57) ABSTRACT

The present disclosure relates to compositions and methods for enhancing T cell response and/or CAR cell expansion and/or maintenance in vivo and/or in vitro. For example, a method of enhancing T cell-based therapy comprises administering genetically modified T cells comprising a first chimeric antigen receptor (CAR) and a second CAR, wherein a binding domain of the first CAR binds a first antigen, and a binding domain of the second CAR binds a second antigen. The first antigen is different from the second antigen. In embodiments, the first CAR binds a surface molecule or antigen of a white blood cell.

7 Claims, 51 Drawing Sheets
Specification includes a Sequence Listing.

(56) References Cited

U.S. PATENT DOCUMENTS

| | | | |
|---|---|---|---|
| 2016/0024175 A1 | 1/2016 | Chow et al. | |
| 2016/0250258 A1 | 9/2016 | Delaney et al. | |
| 2016/0256488 A1 | 9/2016 | Wu | |
| 2016/0362472 A1 | 12/2016 | Bitter et al. | |
| 2017/0015746 A1 | 1/2017 | Jensen | |
| 2017/0096638 A1 | 4/2017 | Wu | |
| 2017/0136063 A1 | 5/2017 | Perez et al. | |
| 2017/0137783 A1 | 5/2017 | Bedoya et al. | |
| 2017/0145094 A1 | 5/2017 | Galetto | |
| 2017/0145108 A1 | 5/2017 | Schreiber et al. | |
| 2017/0209492 A1 | 7/2017 | June et al. | |
| 2017/0218337 A1 | 8/2017 | Friedman | |
| 2017/0224798 A1 | 8/2017 | Cooper et al. | |
| 2017/0319638 A1 | 11/2017 | Conner et al. | |
| 2017/0335281 A1 | 11/2017 | Loew et al. | |
| 2017/0362325 A1 | 12/2017 | Jung et al. | |
| 2017/0368098 A1 | 12/2017 | Chen et al. | |
| 2018/0028631 A1 | 2/2018 | Chen | |
| 2018/0153977 A1 | 6/2018 | Wu et al. | |
| 2018/0179289 A1 | 6/2018 | Xiao et al. | |
| 2018/0222995 A1 | 8/2018 | Xiao et al. | |
| 2018/0223255 A1 | 8/2018 | Wu et al. | |
| 2018/0243340 A1 | 8/2018 | Varadarajan et al. | |
| 2018/0346876 A1 | 12/2018 | Xiao et al. | |
| 2019/0000878 A1 | 1/2019 | Xiao et al. | |
| 2019/0185817 A1 | 6/2019 | Melton et al. | |
| 2019/0216851 A1 | 7/2019 | Xiao et al. | |
| 2019/0314411 A1 | 10/2019 | Xiao et al. | |
| 2020/0155598 A1 | 5/2020 | Xiao et al. | |
| 2021/0060069 A1 | 3/2021 | Xiao et al. | |
| 2021/0100841 A1 | 4/2021 | Xiao et al. | |
| 2021/0137983 A1 | 5/2021 | Xiao et al. | |
| 2021/0161961 A1 | 6/2021 | Xiao et al. | |
| 2021/0230308 A1 | 7/2021 | Xiao et al. | |
| 2021/0252059 A1 | 8/2021 | Pu et al. | |
| 2021/0379149 A1 | 12/2021 | Pu et al. | |
| 2022/0000921 A1 | 1/2022 | Xiao et al. | |
| 2022/0096546 A1 | 3/2022 | Xiao et al. | |
| 2022/0105134 A1 | 4/2022 | Cao et al. | |
| 2022/0339193 A1 | 10/2022 | Xiao et al. | |
| 2022/0348682 A1 | 11/2022 | Xiao et al. | |

FOREIGN PATENT DOCUMENTS

| | | | | |
|---|---|---|---|---|
| NO | 168969 B | 1/1992 | | |
| WO | WO8303679 A1 | 10/1983 | | |
| WO | WO2008131445 | 10/2008 | | |
| WO | WO2010081738 A1 | 7/2010 | | |
| WO | WO2010126766 A1 | 11/2010 | | |
| WO | WO2012050374 | 4/2012 | | |
| WO | WO2012066495 A2 | 5/2012 | | |
| WO | WO 2012/079000 | * 6/2012 | ............. | C07H 21/04 |
| WO | WO2012079000 A1 | 6/2012 | | |
| WO | WO 2013/123061 | * 8/2013 | ............. | C07K 16/46 |
| WO | WO 2014/011988 | * 1/2014 | ............. | A61K 48/00 |
| WO | WO2014011984 | 1/2014 | | |
| WO | WO2015157384 A1 | 10/2015 | | |
| WO | WO2015157432 A1 | 10/2015 | | |
| WO | WO2016-070136 | 5/2016 | | |
| WO | WO2016090034 A2 | 6/2016 | | |
| WO | WO2016090190 A1 | 6/2016 | | |
| WO | WO2016113203 | 7/2016 | | |
| WO | WO2016164731 A2 | 10/2016 | | |
| WO | WO2016174652 A1 | 11/2016 | | |
| WO | WO2016210293 | 12/2016 | | |
| WO | WO2017011804 A1 | 1/2017 | | |
| WO | WO2017027291 A1 | 2/2017 | | |
| WO | WO2017050884 | 3/2017 | | |
| WO | WO2017075537 A1 | 5/2017 | | |
| WO | WO2017120525 A1 | 7/2017 | | |
| WO | WO2017040324 | 9/2017 | | |
| WO | WO2017149515 | 9/2017 | | |
| WO | WO2017167217 A1 | 10/2017 | | |
| WO | WO2017172981 | 10/2017 | | |
| WO | WO2017173403 | 10/2017 | | |
| WO | WO2017177137 | 10/2017 | | |
| WO | WO2018013918 | 1/2018 | | |
| WO | WO2018018958 | 2/2018 | | |
| WO | WO2018023976 A1 | 2/2018 | | |
| WO | WO2018027155 | 2/2018 | | |
| WO | WO2018049418 | 3/2018 | | |
| WO | WO2018067697 | 4/2018 | | |
| WO | WO2018106732 A1 | 6/2018 | | |
| WO | WO2018111763 A1 | 6/2018 | | |
| WO | WO2019091478 | 5/2019 | | |
| WO | WO2019136305 A1 | 7/2019 | | |
| WO | WO2019140100 A1 | 7/2019 | | |
| WO | WO2019178576 A1 | 9/2019 | | |
| WO | WO2020086742 | 4/2020 | | |
| WO | WO2020086989 A1 | 4/2020 | | |
| WO | WO2020106843 A1 | 5/2020 | | |
| WO | WO2020146743 A1 | 7/2020 | | |

OTHER PUBLICATIONS

Magee et al. (Oncoimmunology, 5(10): 1-10, 2016).*
European Office Action mailed Mar. 17, 2022 for European Patent Application No. 19700326.2, a foreign counterpart to U.S. Pat. No. 10,561,686, 7 pages.
Partial European Search Report mailed May 4, 2022 for European Patent Application No. 19854895.0, 13 pages.
Japanese office action mailed Apr. 5, 2022 in Japanese Application No. 2021-512204, a foreign corresponding application of U.S. Appl. No. 17/220,387, 10 pages. Translated.
Marks et al., "By-passing Immunization: Human Antibodies from V-gene Libraries Displayed on Phage" 1991. Journal of Molecular Biology, 222(3): 581-597.
Canadian Office Action mailed Jul. 20, 2022 for Canadian Patent Application No. 3,088,161, a foreign counterpart to U.S. Pat. No. 10,561,686, 4 pages.
Chmielewski, et al., "IL-12 Release by Engineered T Cells Expressing Chimeric Antigen Receptors Can Effectively Muster and Antigen-Independent Macrophage Response on Tumor Cells That Have Shut Down Tumor Antigen Expression", Cancer Research, Jul. 2011, 71(17):5697-5706.
Extended European Search Report mailed Nov. 14, 2022 for European Patent Application No. 19887928.0, a foreign corresponding application of U.S. Appl. No. 16/445,965, 12 pages.
Extended European Search Report mailed Nov. 24, 2022 for European Patent Application No. 20739064.2, a foreign corresponding application of U.S. Appl. No. 16/387,166, 13 pages.
European Search Report mailed Aug. 4, 2022 in European Application No. 19854895.0, a foreign corresponding application of U.S. Appl. No. 17/270,571, 8 pages.
Hoyos, et al., "Engineering CD19-specific T lymphocytes with interleukin-15 and a suicide gene to enhance their anti-lymphoma/leukemia effects and safety", Leukemia, Apr. 2010, 24(6):1160-1170.
Japanese Office Action mailed Sep. 20, 2022 for Japanese Patent Application No. 2020-558861, a foreign counterpart to U.S. Pat. No. 10,561,686, 7 pages.
Klaver, et al., "Plasma IFN-[gamma] and IL-6 levels correlate with peripheral T-cell numbers but not toxicity in RCC patients treated with CAR T-cells", Clinical Immunology, Jul. 2016, 169:107-113.
Koneru, et al., "IL-12 Secreting tumor-targeted chimeric antigen receptor T cells eradicate ovarian tumors in vivo", Oncoimmunology, Jan. 2015, 4(3):e994446, 11 pages.
Posey et al., "Engineered Car T Cells Targeting the Cancer-Associated Tn-Glycoform of the Membrane Mucin MUC1 Control Adenocarcinoma", Immunity, Jun. 2016, 44(6):1444-1454.
Leon-Triana, et al., "Dual-Target CAR-Ts with On- and Off-Tumor Activity May Override Immune Suppression in Solid Cancers: A Mathematical Proof of Concept", Cancers, Feb. 2021, 13(4):703, 20 pages.
Trinchieri, "Interleukin-12 and the regulation of innate resistance and adaptive immunity", Nature Reviews Immunology. Feb. 2003, 3(2):133-146.

(56) References Cited

OTHER PUBLICATIONS

Ghadially, et al., "Differential Regulation of CCL22 Gene Expression in Murine Dendritic Cells and B Cells", The Journal of Immunology, May 2009, 174(9):5620-5629.
Kim, et al., "Increased IL-12 inhibits B cells' differentiation to germinal center cells and promotes differentiation to short-lived plasmablasts", The Journal of Experimental Medicine, Sep. 2008, 205(10):2437-2448.
Largeot, et al., "The B-Side of Cancer Immunity: The Underrated Tune", Cells, May 2019, 8(449):1-20.
"Anti-ACPP Product Datasheet", Atlas Antibodies, retrieved on Oct. 31, 2019 from https://www.atlasantibodies.com/api/print_datasheet/HPA004335.pdf, Dec. 2012 1 page.
"Anti-UPK2 Product Datasheet", Atlas Antibodies, retrieved on Oct. 31, 2019 from https://www.atlasantibodies.com/api/print_datasheet/HPA061106.pdf, Dec. 2012, 1 page.
Invitation to Pay Additional Fees mailed on Nov. 13, 2019 for PCT Application PCT/US19/48890, 3 Pages.
International Preliminary Report on Patentability mailed Mar. 11, 2021 for PCT Application No. PCT/US19/48890, 8 pages.
International Search Report and Written Opinion mailed on Feb. 7, 2020 for PCT Application No. PCT/US19/48890, 15 pages.
U.S. Appl. No. 16/146,218, filed Sep. 28, 2018, US-2019-0216851-A1, U.S. Pat. No. 10,561,686, Granted.
U.S. Appl. No. 16/961,418, filed Jul. 10, 2020, US 2022-0265708 A1, Pending.
U.S. Appl. No. 16/445,965, filed Jun. 19, 2019, US-2020-0155598-A1, U.S. Pat. No. 10,918,667, Granted.
U.S. Appl. No. 17/144,800, filed Jan. 8, 2021, US 2021-0161961 A1, Pending.
U.S. Appl. No. 17/295,364, filed May 19, 2021, US 2022-0000921 A1, Pending.
U.S. Appl. No. 17/749,824, filed May 20, 2022, US-2022-0339193-A1, Pending.
U.S. Appl. No. 16/387,166, filed Apr. 17, 2019, US 2019-0314411 A1, U.S. Pat. No. 10,869,888, Granted.
U.S. Appl. No. 17/091,741, filed Nov. 6, 2020, US 2021-0137983 A1, Pending.
U.S. Appl. No. 17/108,076, filed Dec. 1, 2020, US 2021-0077532 A1, Pending.
U.S. Appl. No. 17/420,066, filed Jun. 30, 2021, US 2022/0096546 A1, Pending.
U.S. Appl. No. 17/270,571, filed Feb. 23, 2021, US 2022-0348682 A1, Pending.
U.S. Appl. No. 17/220,387, filed Apr. 1, 2021, US 2021-0230308 A1, U.S. Pat. No. 11,161,913, Granted.
U.S. Appl. No. 17/123,732, filed Dec. 16, 2020, Pending.
U.S. Appl. No. 17/173,504, filed Feb. 11, 2021, US 2021-0252059 A1, Pending.
U.S. Appl. No. 17/996,589, filed Oct. 19, 2022, Pending.
U.S. Appl. No. 16/996,237, filed Aug. 18, 2020, US 2021-0060069 A1, Pending.
U.S. Appl. No. 17/331,289, filed May 26, 2021, US 2021-0371492 A1, Pending.
U.S. Appl. No. 16/999,357, filed Aug. 21, 2020, US 2021-0100841 A1, Pending.
Brischwein et al. "Strictly target cell-dependent activation of T cells by bispecific single-chain antibody constructs of the BiTE class" J Immunother, Nov. 2007, vol. 30, pp. 798-807.
Chmielewski, "Of CARs and TRUCKs: Chimeric antigen receptor (Car) T Cells Engineered with an Inducible Cytokine to Modulate the Tumor Stroma," Jan. 2014. Imunological Reviews, 257(1): 83-90.
European Search Report mailed Aug. 31, 2021 in European Application No. 21275039.2, a foreign corresponding application of U.S. Appl. No. 16/999,357, 13 pages.
Huang et al., "Interleukin-armed Chimeric Antigen Receptor-modified T Cells for Cancer Immunotherapy," Sep. 2017. Gene Thereapy, 25(3):192-197.
International Preliminary Report on Patentability dated Jul. 22, 2021 in PCT Application No. PCT/US2020/013099, 9 pages.
International Search Report & Written Opinion mailed Aug. 13, 2021 from PCT Application No. PCT/2021/028429, 12 pages.
Lee et al., "Use of a Simgle CAR T Cell and Several Bispecific Adapters Facilitates Eradication of Multiple Antigenically Diffeerent Solid Tumors," Nov. 2018. Cancer Research, 79(2): 387-396.
Wong et al. "Blinatumomab induces autologous T-cell killing of chronic lymphocytic leukemia cells," Jun. 2013, Haematologica, vol. 98(12): 1930-1938.
Bollino et al., "Chimeric Antigen Receptor-Engineered Natural Killer and Natural Killer T cells for Cancer Immunotherapy," Translational Research, Jun. 2017, 187:32-43.
Bork, P., "Powers and Pitfalls in Sequence Analysis: The 70% Hurdle," Genome Research, 2000, 10:398-400.
Bowie et al., "Deciphering the Message in Protein Sequences: Tolerance to Amino Acid Substitutions," Science, Mar. 1990, 247:1306-1310.
Burgess et al., "Possible Dissociation of the Heparin-binding and Mitogenic Activities of Heparin-binding (Acidic Fibroblast) Growth Factor-1 from its Receptor-binding Activities by Site-directed Mutagenesis of a Single Lysine Residue," J. Cell Biol., Nov. 1990, 111:2129-2138.
Cherkassky et al., "Human CAR T Cells with Cell-intrinsic PD-1 Checkpoint Blockade Resist Tumor-mediated Inhibition," Journal of Clinical Investigation, May 2016, 126(8):3130-3144.
Chmielewski et al., "CAR T Cells Releasing IL-18 Convert to T-Bethigh FoxO1low Effectors that Exhibit Augmented Activity Against Solid Tumors," Cell Reports, Dec. 2017, 21:3205-3219.
Duong et al., "Bacteria-cancer Interactions: Bacteria-based Cancer Therapy," Experimental & Molecular Medicine, 2019, 51:152, 15 pages.
Eyquem et al., "Targeting a CAR to the TRAC Locus with CRISPR/Cas9 Enhances Tumour Rejection," Nature, Mar. 2017, 543:113-117.
Fang et al., "NK Cell-based Immunotherapy for Cancer," Seminars in Immunology, Aug. 2017, 31:37-54.
Grada et al., "TanCar: A Novel Bispecific Chimeric Antigen Receptor for Cancer Immunotherapy," Molecular Therapy—Nucleic Acids, Jul. 2013, vol. 2:e105, 11 pages.
Japanese Office Action mailed May 30, 2023 for Japanese Patent Application No. 2020-558861, a foreign counterpart to U.S. Pat. No. 10,561,686, 7 pages.
Lazar et al., "Transforming Growth Factor Alpha: Mutation of Aspartic Acid 47 and Leucine 48 Results in Different Biological Activities," Mol. Cell. Biol., Mar. 1988, 8(3):1247-1252.
Liu et al., "A Chimeric Switch-receptor Targeting PD1 Augments the Efficacy of Second-Generation Car T Cells in Advanced Solid Tumors," Cancer Research, Mar. 2016, 76(6):1578-1590.
Magee et al., "GUCY2C-directed CAR-T Cells Oppose Colorectal Cancer Metastases Without Autoimmunity," Oncolmmunology, Oct. 2016, 5(1):e1227897, 11 pages.
Mirzaei et al, "Chimeric Antigen Receptors T Cell Therapy in Solid Tumor: Challenges and Clinical Applications," Fronteirs in Immunology, Dec. 2017, 8:1850, 13 pages.
Roybal et al., "Engineering T cells with Customized Therapeutic Response Programs Using Synthetic Notch Receptors," Cell, Oct. 2016, 167:419-432.
Sarvaria et al., "B cell Regulation in Cancer and Anti-Tumor Immunity", Cellular and Molecular Immunology, Apr. 2017, 14:662-674.
Singapore Office action mailed Feb. 28, 2023, in Singapore Application No. 11202107269X, a corresponding foreing application of U.S Appl. No. 16/387,166, 12 pages.
Turtle et al., "Immunotherapy of Non-Hodgkin's Lymphoma with a Defined Ratio of CD8+ and CD4+ CD19-specific Chimeric Antigen Receptor-modified T cells," Science Translational Medicine, Sep. 2016, 8:355, 29 pages.
Zhou et al, "The Use of tMUC1 Highly Specific Chimeric Antigen Receptor-redirected T cells for the Eradication of Triple Negative Breast Cancer," J Immunol, May 2017, 198 (1 Supplement):198.10, 2 pages, Abstract.

(56) References Cited

OTHER PUBLICATIONS

Chen, et al., "CAR T-cell intrinsic PD-1 checkpoint blockade: a two-in-one approach for solid tumor immunotherapy," Feb. 2017, Oncolmmunology, 6:2, e1273302, DOI: 10.1080/2162402X.2016.1273302. 4 pages.
Extended European Search Report mailed Nov. 25, 2019 in EP Application No. 19180127.3, Xiao et al., a corresponding foreign application of U.S. Appl. No. 16/146,218, 11 pages.
Fang et al., "Stable antibody expression at therapeutic levels using the 2A peptide," May 2005, Nature Biotechnology. 23(5):584-590.
PCT Communication Invitation to Pay Fees mailed Mar. 30, 2020 for PCT Application No. PCT/US20/13099, "Modified Cell Expansion and Uses Thereof", 2 pages.
Jernberg-Wiklund, et al., "Recombinant interferon-gamma inhibits the growth of IL-6-dependent human multiple myeloma cell lines in vitro," 1991. Eur J Haematol, 46:231.239.
Lee et al., "T cells expressing CD19 chimeric antigen receptors for acute lymphoblastic leukemia in children and young adults: a phase 1 dose-escalation trial," Oct. 2014. The Lancet, 385(9967): 517-528.
Maude et al., "Chimeric antigen receptor T cells for sustained remissions in leukemia," Octonber 2014. N Engl J Med. 371(16): 1507-1517.
Milone, et al., "Chimeric receptors containing CD137 signal transduction domains mediate enhanced survival of T cells and increased antileukemic efficacy in vivo," Apr. 2009. Molecular Therapy, 17(8): 1453-1464.
Office Action for U.S. Appl. No. 16/146,218, mailed on Oct. 8, 2019, Xiao, "Modified Cell Expansion and Uses Thereof", 10 pages.
Office Action for U.S. Appl. No. 16/387,166, mailed on Mar. 16, 2020, Xiao et al., "Modified Cell Expansion and Uses Thereof", 21 pages.
Office Action for U.S. Appl. No. 16/445,965, mailed on May 1, 2020, Xiao, "Modified Cell Expressing Therapeutic Agent and Uses thereof", 10 pages.
Partial European Search Report mailed Nov. 4, 2019 in U.S. Appl. No. 16/146,218, Xiao et al., a corresponding foreign application of U.S. Appl. No. 16/146,218, 18 pages.
The PCT Search Report and Written Opinion mailed on Jun. 17, 2019 for PCT Application No. PCT/US19/13068, 14 pages.
The PCT Search Report and Written Opinion mailed on Feb. 20, 2020 for PCT Application No. PCT/US19/62417, 14 pages.
The PCT Search Report and Written Opinion mailed on Jun. 4, 2020 for PCT Application No. PCT/US2020/013099, 13 pages.
Qin et al., "Incorporation of a hinge domain improves the expansion of chimeric antigen receptor T cells," 2017, Journal of Hematology & Oncology, 10:68, 11 pages.
Sahm et al, "Expression of IL-15 in NK Cells Results in Rapid Enrichment and Selective Cytotoxicity of Gene-Modified Effectors That Carry a Tumor-Specific Antigen Receptor," Sep. 2012, Cancer Immunol Immunother, 61(9): 1451-1461.
Takahashi, et al, "Expression of MUC1 on myeloma cells and induction of HJLA-unrestricted CTL against MUC1 from a multiple myeloma patient," 1994. J Immunol, 153:2102-2109.
Wilkie, et al. "Retargeting of human T cells to tumor-associated MUC1: The evolution of a chimeric antigen receptor," 2008, J. Immunol., 180:4901-4909.
You et al., "Phase 1 clinical trial demonstrated that MUC1 positive metastatic seminal vesicle cancer can be effectively eradicated y modified Anti-MUC1 chimeric antigen receptor transduced T cells", Apr. 2016, Science China: Life Sciences, 59(4): 386-397.
Canadian Office Action for Canadian Patent Appl.: 3,088,161, mailed Sep. 22, 2021, a foreign corresponding application of U.S. Appl. No. 16/999,357, 4 pages.
U.S. Appl. No. 16/146,218, filed Sep. 28, 2018, US-2019-0216851-A1, U.S. Pat. No. 10,561,686, Issued.
U.S. Appl. No. 16/961,418, filed Jul. 10, 2020, Pending.
U.S. Appl. No. 16/445,965, filed Jun. 19, 2019, US-2020-0155598-A1, Allowed.
U.S. Appl. No. 17/144,800, filed Jan. 8, 2021, Pending.
U.S. Appl. No. 16/387,166, filed Apr. 17, 2019, US 2019-0314411 A1, U.S. Pat. No. 10,869,888, Issued.
U.S. Appl. No. 17/108,076, filed Dec. 1, 2020, Pending.
U.S. Appl. No. 17/091,741, filed Nov. 6, 2020, Pending.
U.S. Appl. No. 16/996,237, filed Aug. 18, 2020, Pending.
U.S. Appl. No. 16/999,357, filed Aug. 21, 2020, Pending.
U.S. Appl. No. 17/173,504, filed Feb. 11, 2021, Pending.
Supplemental European Search Report mailed Jan. 13, 2020 in EP Application No. 19700326, Xiao et al., a corresponding foreign application of U.S. Appl. No. 16/146,218, 7 pages.
Xiao et al., "Pre-clinical experiments of cart cells identifying tshr as a potential target against metastatic thyroid cancer," May 2018. Database EMBASE [Online] Elsevier Science Publishers, Database Accession No. EMB-623339571, 1 page.
Rizzardi, et al., "Evaluation of Protein Biomarkers of Prostate Cancer Aggressiveness," Dec. 2014. BMC Cancer, 14(1): 14 pgs.
Canadian Office Action mailed Sep. 1, 2023 for Canadian Patent Application No. 3,125,646, a foreign counterpart to U.S. Pat. No. 10,869,888, 4 pages.
Altuntas et al., "Autoimmunity to Uroplakin II Causes Cystitis in Mice: A Novel Model of Interstitial Cystitis," Eur Urol, Jan. 2012, 61(1): 193-200.
Auerbach et al., "Angiogenesis Assays: Problems and Pitfalls," Cancer and Metastasis Reviews, Jun. 2000, 19:167-172.
Beans, "Targeting Metastasis to Halt Cancer's Spread," PNAS, Dec. 2018, 115(50):12539-12543.
Canadian Office Action mailed Sep. 14, 2023 for Canadian Application No. 3120153, a foreign corresponding application of U.S. Appl. No. 17/295,364, 4 pages.
Canadian Office Action mailed Sep. 19, 2023 for Canadian Application No. 3110096, a foreign corresponding application of U.S. Appl. No. 17/270,571, 3 pages.
Gravanis et al., "The Changing World of Cancer Drug Development: The Regulatory Bodies' Perspective," Chinese Clinical Oncology, May 2014, 3(2):22, 5 pages.
Gura, "Systems for Identifying New Drugs Are Often Faulty," Science, Nov. 1997, 278(5340):1041-1042.
Hait, "Anticancer Drug Development: The Grand Challenges," Nature Reviews/Drug Discovery, Apr. 2010, 9:253-254.
Heppner et al., "Tumor Heterogeneity: Biological Implications and Therapeutic Consequences," Cancer Metastasis Review 1983, 2:5-23.
Hoang et al, "A Newly Developed Uroplakin II Antibody With Increased Sensitivity in Urothelial Carcinoma of the Bladder," Arch Pathol Lab Med, Jul. 2014, 138:943-949.
Jain, "Barriers to Drug Delivery in Solid Tumors," Scientific American, Jul. 1994, 271(1):58-65.
Japanese Office Action mailed Oct. 17, 2023 for Japanese Application No. 2021-527959, a foreign corresponding application of U.S. Appl. No. 17/295,364, 6 pages.
Japanese Office Action mailed Oct. 31, 2023 for Japanese Application No. 2022-154638, aa foreign corresponding application of U.S. Appl. No. 17/270,571, 6 pages.
Liou et al., "Macrophage-secreted Cytokines Drive Pancreatic Acinar-to-ductal Metaplasia Through NF-KB and MMPs," Journal of Cell Biology, 2013, 202(3):563-577.
Mishu et al., "Effects of Recombinant Canine Granulocyte Colony-stimulating Factor on White Blood Cell Production in Clinically Normal and Neutropenic Dogs," J Am Vet Med Assoc., Jun. 1992, 200(12), Abstract, 1 page.
Ping et al., "T-cell Receptor-engineered T Cells for Cancer Treatment: Current Status and Future Directions," Protein Cell, Mar. 2018, 9(3):254-266.
Rahman et al., "Histology, Natural Killer Cells," retrieved from «https://www.ncbi.nlm.nih.gov/books/NBK565844/», StatPearls Publishing, Feb. 2023, 6 pages.
Rohaan et al., "Adoptive Cellular Therapies: The Current Landscape," Virchows Archiv, Nov. 2018, 474:449-461.
Snook et al., "GUCY2C-targeted Cancer Immunotherapy: Past, Present and Future," Immunology Research, Dec. 2011, 51:161-169.
Sporn et al., "Chemoprevention of Cancer", Carcinogenesis, Mar. 2000, 21(3):525-530.

(56) References Cited

OTHER PUBLICATIONS

Tigner et al., "Histology, White Blood Cell," retrieved from «https://www.ncbi.nlm.nih.gov/books/NBK563148/», StatPearls Publishing, Nov. 2022, 5 pages.
Yu et al., "CART Cell Therapy for Prostate Cancer: Status and Promise," OncoTargets and Therapy, 2019, 12:391-395.
Canadian Office Action mailed Oct. 25, 2023 for Canadian Application No. 3,088,161, a foreign counterpart to U.S. Pat. No. 10,561,686, 4 pages.
Japanese Office Action mailed Jan. 16, 2024 for Japanese Application No. 2020-558861, a foreign counterpart to U.S. Pat. No. 10,561,686, 7 pages.

* cited by examiner

Anti-Muc1 & anti-CD19 CAR T cells, derived.

FIG. 6A
FIG. 6B
FIG. 6C
FIG. 6D
FIG. 6E
FIG. 6F

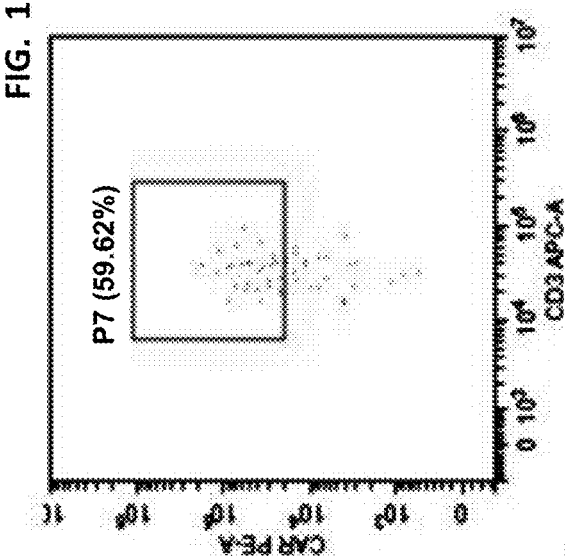
FIG. 15A  IgG
FIG. 15B  Anti-scFv
FIG. 15C  Gated by single live mCD45-hCD3+ cells, mouse PB
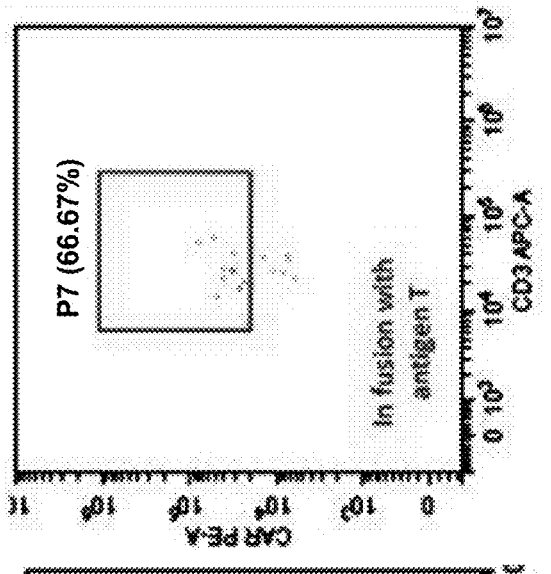
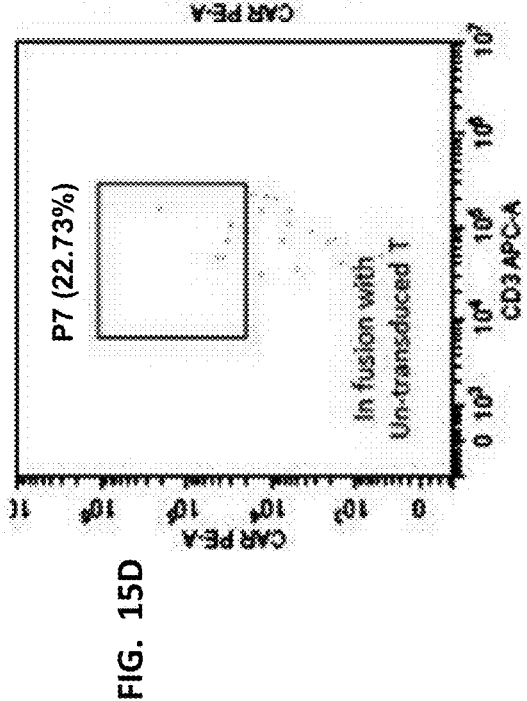
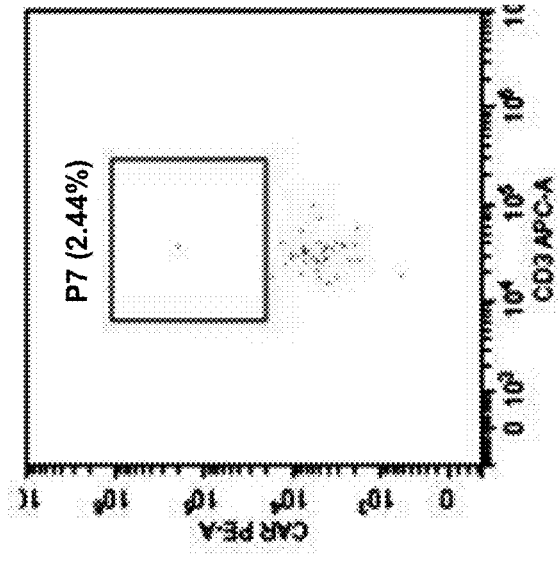
FIG. 15D
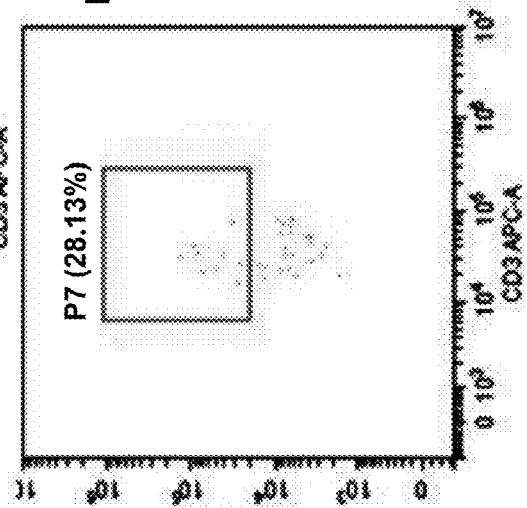
FIG. 15E
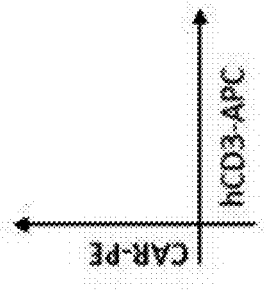

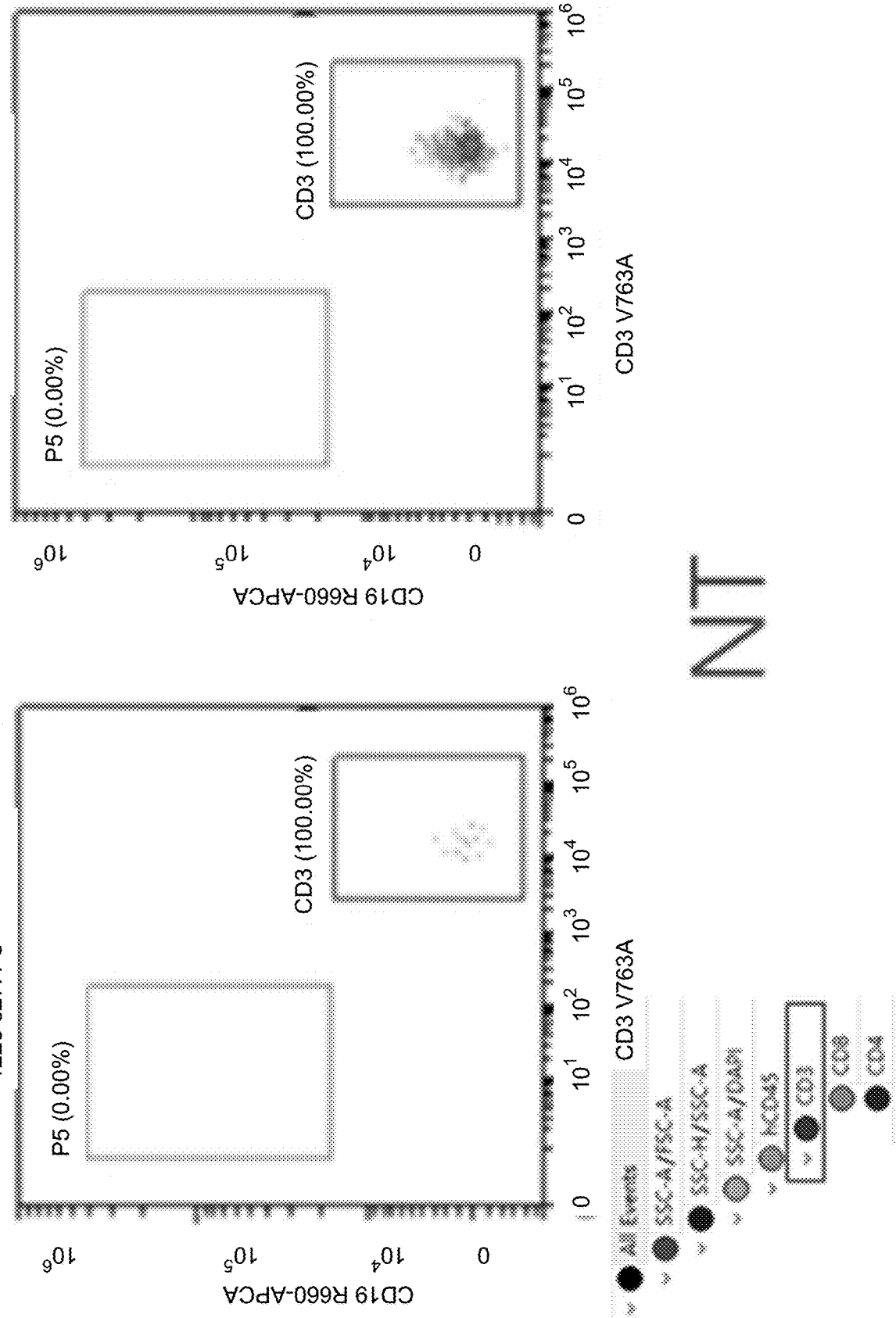

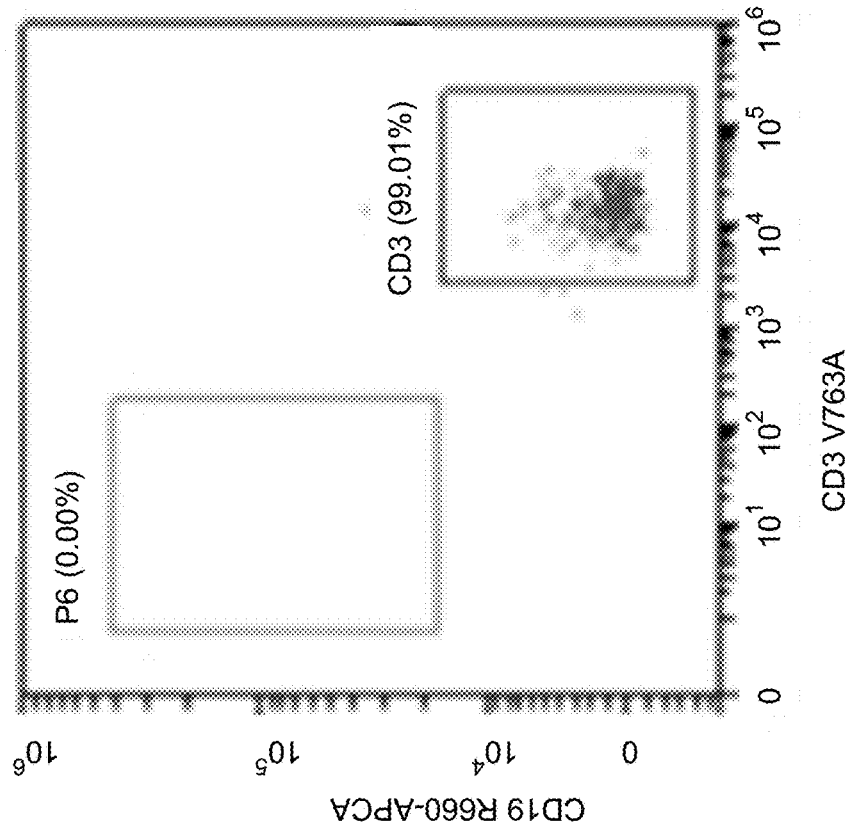
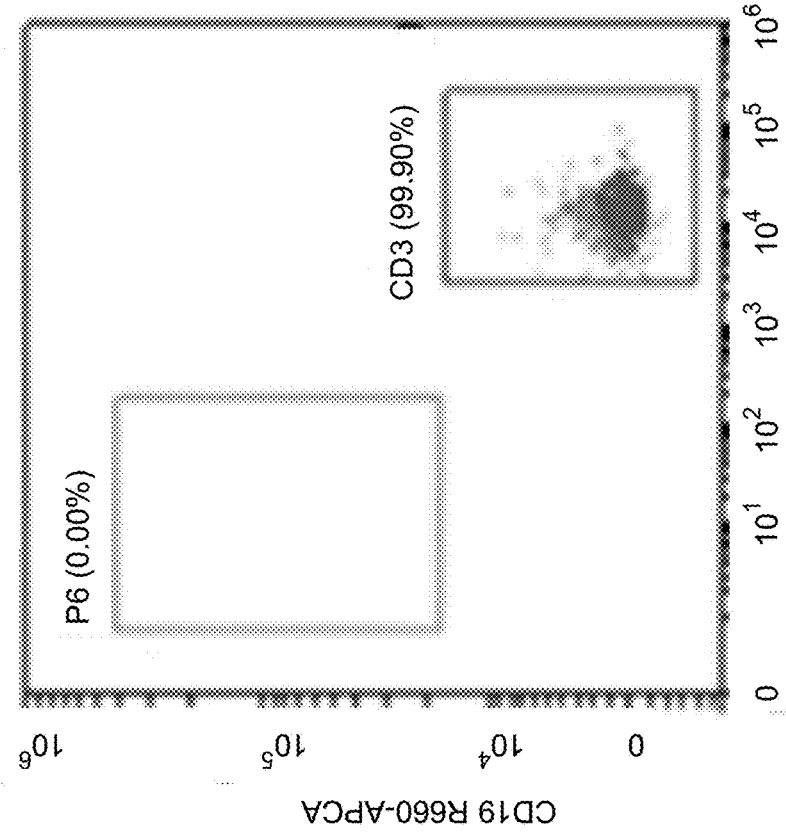
FIG. 21A
FIG. 21B

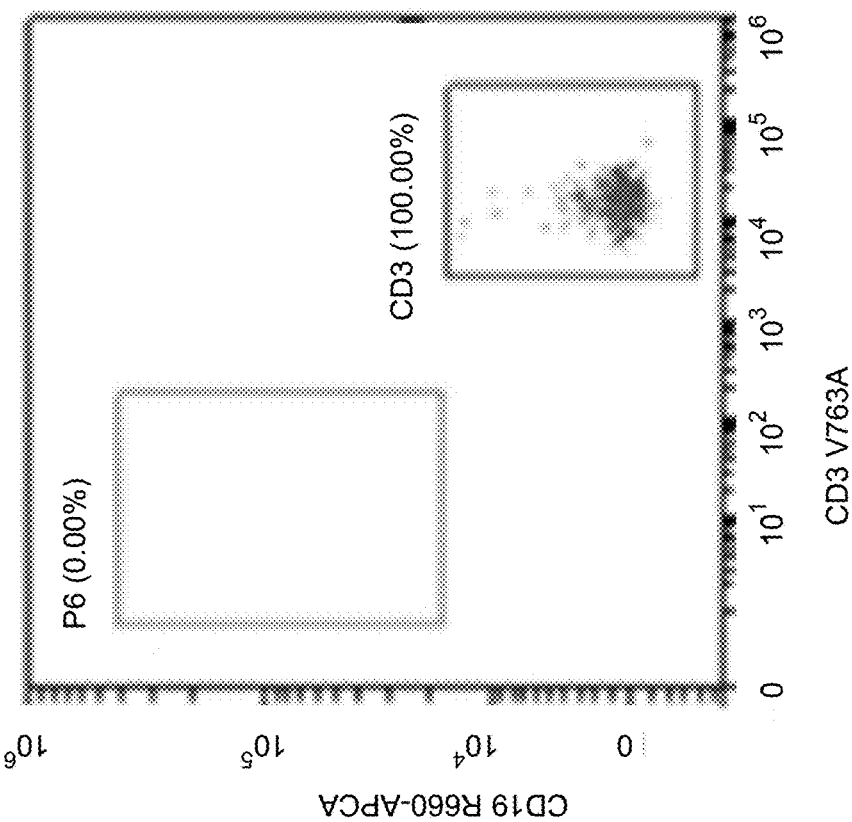
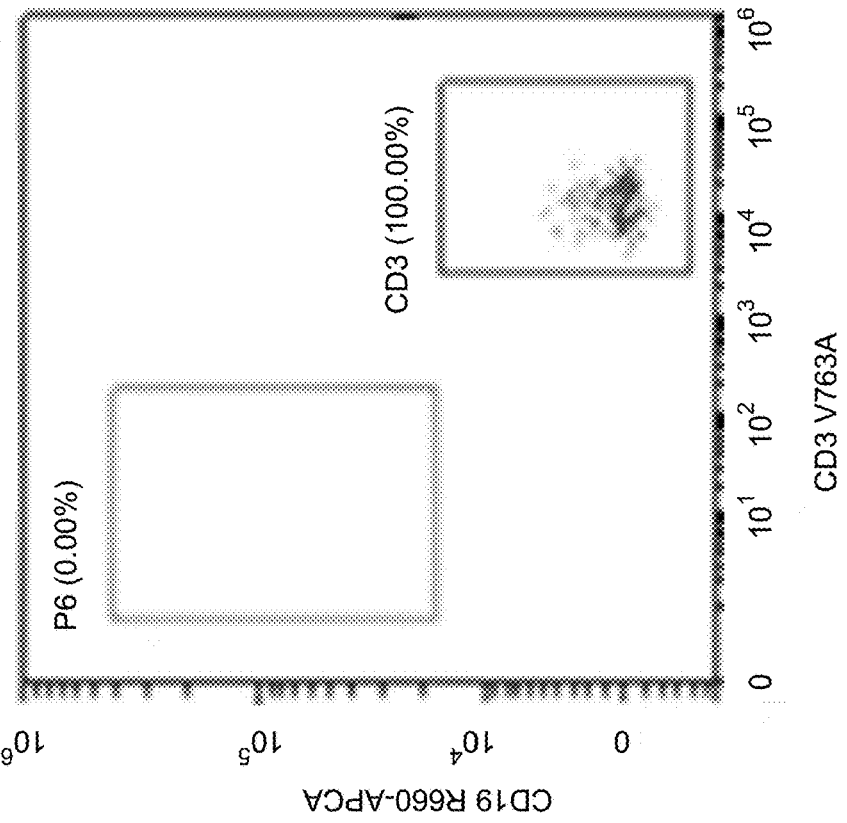
FIG. 22A
FIG. 22B 1228 827: CD3

P8 (76.67%)
P9 (23.33%)

1228 831: CD3

P8 (77.59%)
P9 (18.85%)

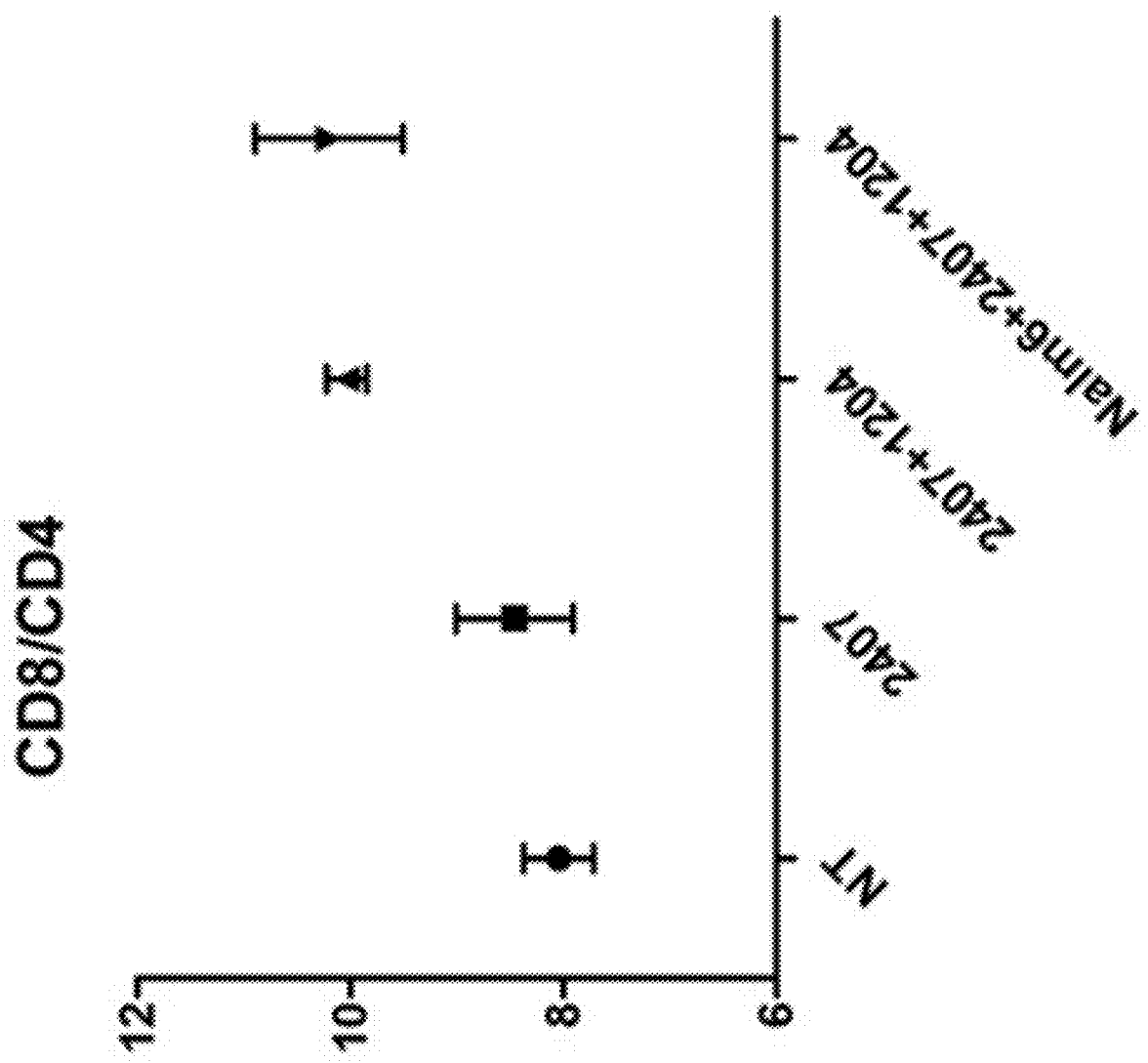

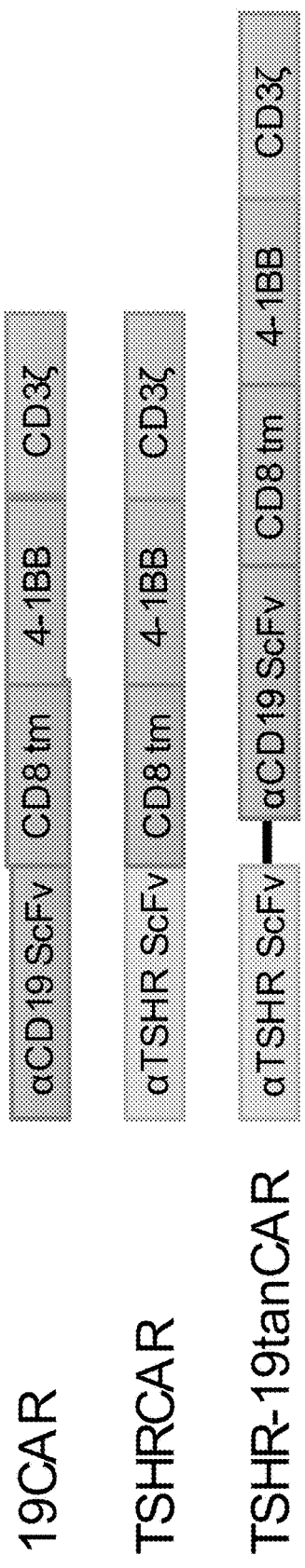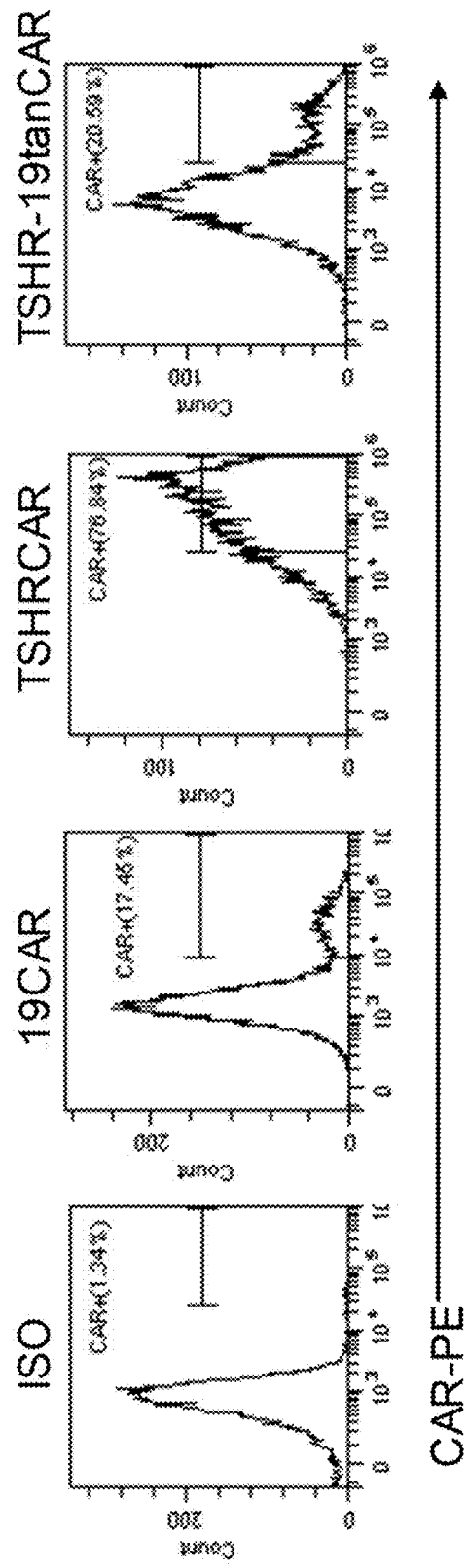
FIG. 33

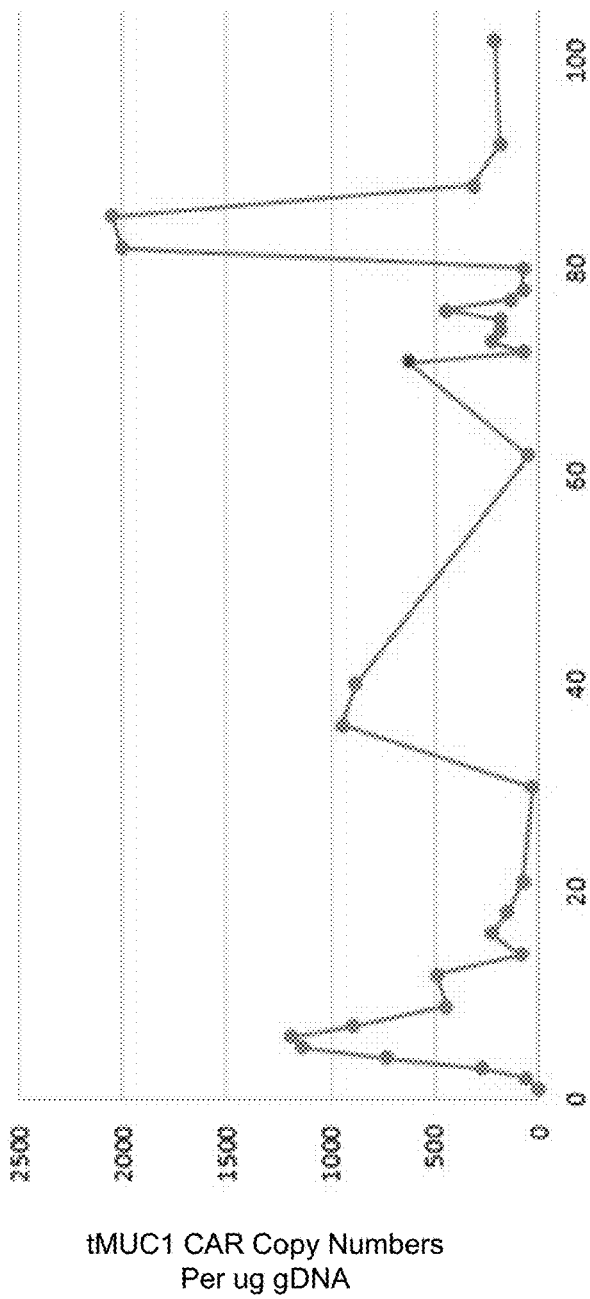
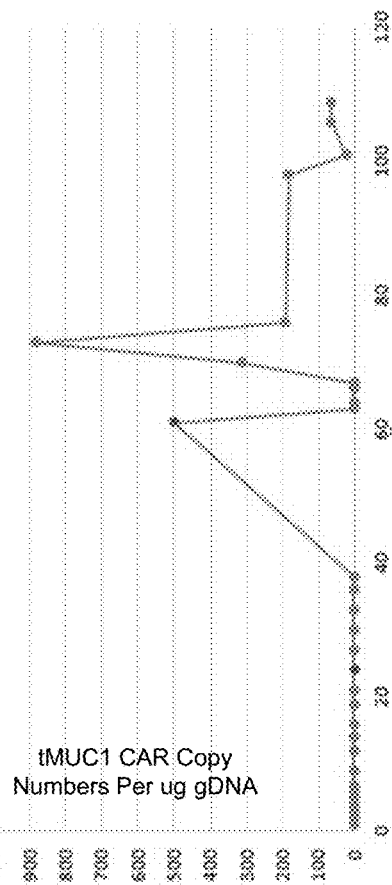
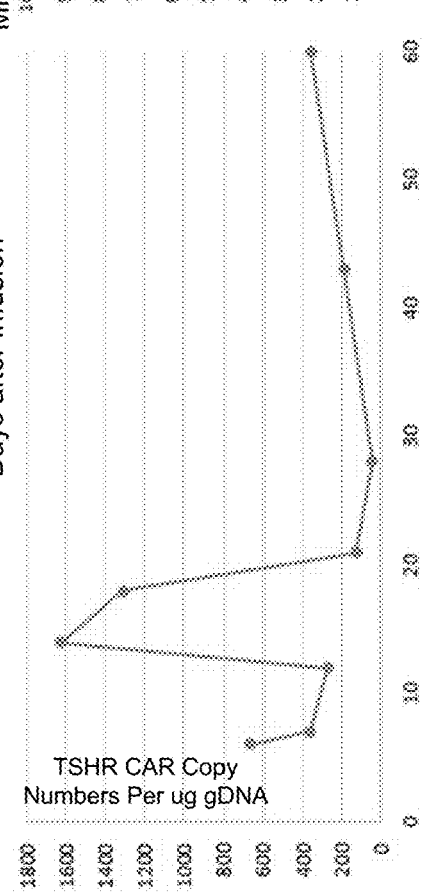
FIG. 38A
FIG. 38B
FIG. 38C

FIG. 43

19CAR — αCD19 ScFv — CD8 tm — 4-1BB — CD3ζ

CLDN18.2CAR — αCLDN18.2 ScFv — CD8 tm — 4-1BB — CD3ζ

CLDN18.2-19tanCAR — αCLDN18.2 ScFv — αCD19 ScFv — CD8 tm — 4-1BB — CD3ζ

A, B, C, and D constructs:

A: CD8sp-- Anti-18.2(175)-VL --3*GGGGS linker-- Anti-18.2(175)-VH --4*GGGGS tanCAR linker--humanized-anti CD19-VH --3*GGGGS linker--humanized-anti CD19-VL-- Humanized-anti CD19-VL B: CD8sp-- Anti-18.2 (175) -VL --3*GGGGS linker-- Anti-18.2 (175) -VH --3*GGGGS linker-- humanized-anti CD19-VL--3*GGGGS tanCAR linker-- humanized-anti CD19-VL --3*GGGGS linker-- humanized-anti CD19-VH C: CD8sp-- humanized-anti CD19-VL--3*GGGGS linker-- humanized-anti CD19-VH --4*GGGGS tanCAR linker-- Anti-18.2 (175) -VL -- 3*GGGGS linker-- Anti-18.2 (175) -VH D: CD8sp-- humanized-anti CD19-VL--3*GGGGS linker-- humanized-anti CD19-VH --4*GGGGS tanCAR linker-- Anti-18.2 (175) -VH -- 3*GGGGS linker-- Anti-18.2 (175) -VL 175, 163, 125, and 43 refer to antibodies

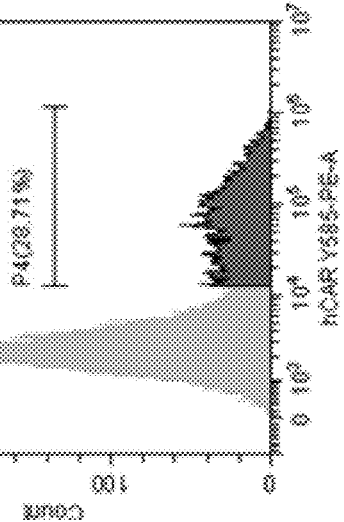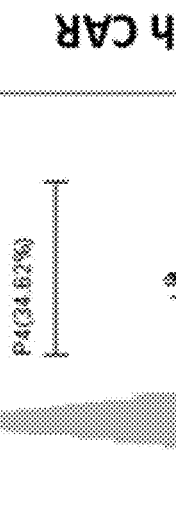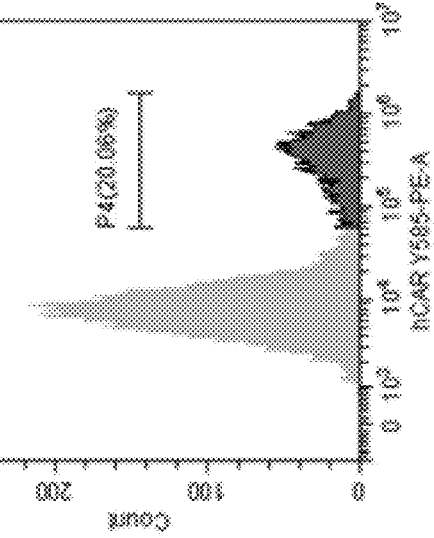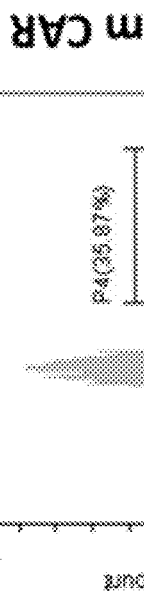
FIG. 44A
FIG. 44B
FIG. 44C
FIG. 44D

MODIFIED CELL EXPANSION AND USES THEREOF

CROSS REFERENCE TO RELATED PATENT APPLICATIONS

This application is a continuation of co-pending U.S. application Ser. No. 16/387,166, filed Apr. 17, 2019, now U.S. Pat. No. 10,869,888, which is a continuation-in-part of U.S. application Ser. No. 16/146,218, filed on Sep. 28, 2018, now U.S. Pat. No. 10,561,686, and claims the benefit of U.S. Provisional Application 62/817,322, filed on Mar. 12, 2019; U.S. Provisional Application 62/816,497, filed on Mar. 11, 2019; U.S. Provisional Application 62/799,462, filed on Jan. 31, 2019; U.S. Provisional Application 62/790,783, filed on Jan. 10, 2019; U.S. Provisional Application 62/721,791, filed on Aug. 23, 2018; U.S. Provisional Application 62/690,892, filed on Jun. 27, 2018; U.S. Provisional Application 62/659,233, filed on Apr. 18, 2018; U.S. Provisional Application 62/687,059, filed on Jun. 19, 2018; U.S. Provisional Application 62/678,836, filed on May 31, 2018; U.S. Provisional Application No. 62/659,114, filed on Apr. 17, 2018, which are all hereby incorporated by reference in their entirety.

SEQUENCE LISTING INFORMATION

The Sequence Listing associated with this application is provided in text format in lieu of a paper copy and is hereby incorporated by reference into the specification. The name of the file containing the Sequence Listing is SDS1.0075US2 Sequence Listing_ST25.txt. The file is 960,255 bytes, was created on Jun. 22, 2023, and is being submitted electronically via Patent Center.

TECHNICAL FIELD

The present disclosure relates to compositions and methods for expanding and maintaining modified cells including genetically modified cells, and uses thereof in the treatment of diseases, including cancer.

BACKGROUND

Chimeric Antigen Receptor (CAR) T cell therapy has achieved good clinical efficacy in cancer such as B-ALL/CLL/lymphoma. However, progress is relatively slow for treatment of solid tumors. For CAR T cell therapy to be effective, long-term maintenance of CAR T cells in a patient is important for the prognosis of the patient in the treatment of tumors. For example, if the long-term presence of CAR T cells can be maintained, this technology may effectively reduce tumor recurrence.

Cancer is known as malignant tumors involving abnormal cell growth with the potential to invade or spread to other parts of the body. In humans, there are more than one hundred types of cancer. One example is breast cancer occurring in the epithelial tissue of the breast. Since breast cancer cells lose the characteristics of normal cells, the connection between breast cancer cells is lost. Once cancer cells are exfoliated, they spread over the entire body via the blood and/or lymph systems and therefore become life-threatening. Currently, breast cancer has become one of the common threats to women's physical and mental health. Although immunotherapy (e.g., CAR T) has been proven to be effective for treating cancer, there is still a need to improve immunotherapy so that it is more effective for certain cancer such as solid tumors.

SUMMARY

Since a patient can survive the depletion of B cells, B cells of the patient may be used to expand the CAR T cells in the patient using a first antigen binding domain of the CAR T cell. Accordingly, more CAR T cells may be timely expanded in the patient, increasing the potency of CAR T cells. The timely expanded CAR T cells in the patient may increase the chances for the CAR T cells to come in contact with tumor cells, especially solid tumor cells having the antigen that a second CAR binds.

The present disclosure describes genetically modified cells that include one or more different antigen binding domains. The genetically modified cells can include at least two different antigen binding domains: a first antigen binding domain for expanding and/or maintaining the genetically modified cells, and a second antigen binding domain for killing a target cell, such as a tumor cell. For example, the first antigen binding domain binds a surface marker, such as a cell surface molecule of a white blood cell (WBC), and the second antigen binding domain binds a target antigen of tumor cells. In embodiments, the cell surface molecule is a surface antigen of a WBC.

In embodiments, the two antigen binding domains are on the same CAR (a bispecific CAR or tan CAR), on different CAR molecules, or on a CAR and T cell receptor (TCR). A single CAR can include at least two different antigen binding domains, or the two different antigen binding domains are each on a separate CAR.

The present disclosure also describes one or more nucleic acids encoding a first CAR molecule and a second CAR molecule or a TCR. The first CAR includes the first antigen binding domain and the second CAR or TCR includes the second antigen binding domain. In embodiments, the first CAR and the second CAR or TCR are expressed as separate polypeptides and encoded by at least two separate nucleic acids. In embodiments, a single CAR contains at least the first and second antigen binding domains described herein and is encoded by a single nucleic acid. In embodiments, the two different antigen binding domains can be encoded by more than one nucleic acids.

Moreover, the present disclosure describes vectors containing the nucleic acids described herein and cells comprising the nucleic acids described herein. In embodiments, the cells include genetically modified cells, for example genetically modified T cells, such as CAR T cells.

Further, the present disclosure describes a population of modified cells, such as a mixed population of modified T cells, effective for expanding and/or maintaining the genetically modified cells in a patient. In embodiments, the mixed population of genetically modified cells includes at least two different genetically modified cells, a first genetically modified cell expressing an antigen binding domain for expanding and/or maintaining the modified cells and a second genetically modified cell expressing an antigen binding domain for killing a target cell, such as a tumor cell. The two antigen binding domains are different molecules and bind different antigens. In embodiments, the mixed population of genetically modified cells further includes a third genetically modified cell expressing at least two different antigen binding domains, a first antigen binding domain for expanding and/or maintaining the genetically modified cell and a second antigen binding domain for killing a target cell (wherein the two different antigen binding domains are expressed on the same cell).

In embodiments, the mixed population of modified cells includes genetically modified cells expressing at least two different antigen binding domains, a first antigen binding domain for expanding and/or maintaining the modified cells and a second antigen binding domain for killing a target cell (wherein the two different antigen binding domains are expressed on the same cell).

In embodiments, the mixed population of modified cells includes a modified cell expressing an antigen binding domain for killing a target cell and a modified cell expressing at least two antigen binding domains, a first antigen binding domain for expanding and/or maintaining the modified T cells and a second antigen binding domain for killing a target cell (wherein the two different antigen binding domains are expressed on the same modified cell).

In embodiments, the mixed population of modified cells includes a modified cell expressing an antigen binding domain for expanding and/or maintaining the modified T cells and a modified cell expressing at least two antigen binding domains, a first antigen binding domain for expanding and/or maintaining the modified cell and a second antigen binding domain for killing a target cell (wherein the two different antigen binding domains are expressed on the same modified cell).

The present disclosure describes compositions comprising the mixed population of modified cells described herein.

In embodiments, the modified cell is a modified T cell, a modified NK cell, or a modified dendritic cell. In embodiments, the modified T cell is a CAR T cell. In embodiments, the modified cell expressing two different antigen binding domains can be a single CAR T cell. In embodiments, the single CAR T cell can be a bispecific CAR T cell.

In embodiments, the antigen binding domain for expanding/or and maintaining the modified cell binds the surface antigen of a WBC, and the antigen binding domain for killing a target cell binds a tumor antigen. In embodiments, the WBC is a B cell. In embodiments, the surface antigen of a B cell is CD19, and the tumor antigen is MUC1, for example tumor associated MUC1 (tMUC1).

Furthermore, the present disclosure describes the use of the composition or the mixed population of modified cells described herein for enhancing expansion and/or maintenance of CAR T cells in patients in need thereof. The enhanced expansion and maintenance of CAR T cells improves the efficacy of the CAR T cell therapy. The present disclosure describes a method of treating a patient having tumor with a mixed population of modified cells described herein. In embodiments, the mixed population of genetically modified cells expands and/or maintains the modified cells in the patient and effectively inhibits the growth of the tumor. In embodiments, the tumor is a solid tumor.

Additionally, the present disclosure describes the release of cytokines in response to the introduction of the mixed population of modified cells.

This Summary is not intended to identify key features or essential features of the claimed subject matter, nor is it intended to be used to limit the scope of the claimed subject matter.

BRIEF DESCRIPTION OF THE DRAWINGS

The Detailed Description is described with reference to the accompanying figures. The use of the same reference numbers in different figures indicates similar or identical items.

Figures 6A, 6B, 6C, 6D, 6E, 6F:
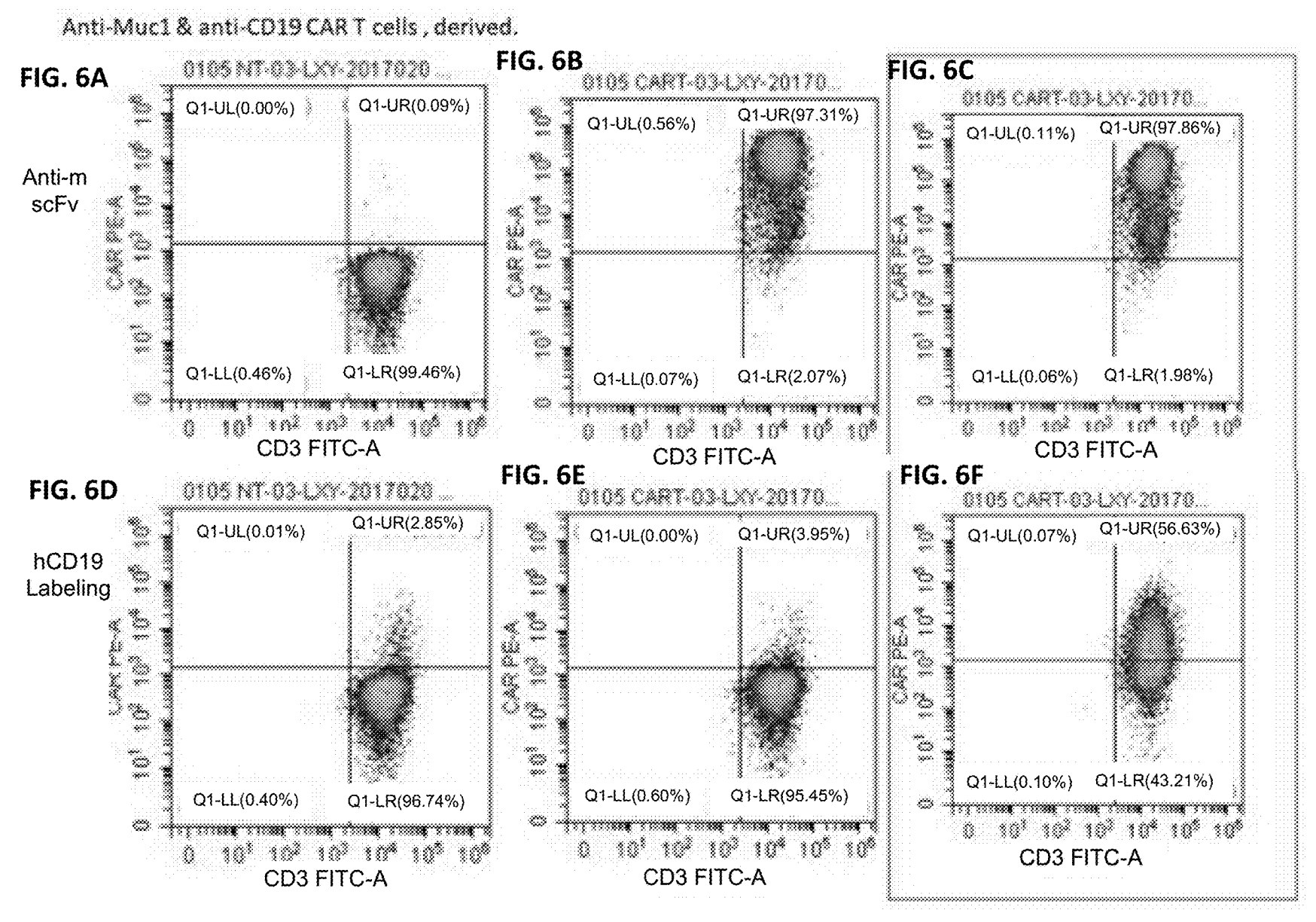

FIGS. 6A-6F display flow cytometry results showing T cells expressing anti-CD19 CAR and anti-MUC1 CAR.

FIGS. 15A-15E show CAR/CD3 cell ratios were increased as compared to control in mouse peripheral blood.

FIGS. 20A-20B, 21A-21B, 22A-22B, and 23A-23B show flow cytometry results of T cells/human leukocytes. The cells were derived from human leukocyte hCD45 in FIGS. 16A-16B, 17A-17B, 18A-18B, and 19A-19B, the horizontal axis represents the fluorescence intensity of CD3 corresponding staining, and the vertical axis represents the fluorescence intensity of CD19 corresponding staining.

FIG. 30 shows results of CD8/CD4. It can be seen from the statistics data in Table 14 that there is no significant difference in the ratio of the four groups of CD8/CD4.

FIG. 33 shows a design of bispecific CAR and expression assay. 3*GGGGS ((GGGGS) 3) is set forth in SEQ ID NO: 124.

FIGS. 38A-38C show CAR copy number changes of patients in response to infusion of T cells expressing a single CAR (tMUC1 CAR or TSHR CAR).

FIG. 43 shows schematic structure of constructs of vectors encoding CAR molecules. 3*GGGGS ((GGGGS) 3) is set forth in SEQ ID NO: 124, and 4*GGGGS ((GGGGS) 4) is set forth in SEQ ID NO: 431.

FIGS. 44A-44D show expression of the CAR molecules shown in FIG. 43. Since CD19 CAR included a humanized antibody, 18.2 CAR is a murine antibody. Therefore, human and murine CAR antibodies were used for detection. The ratio of expression of the two antibodies was detected on bispecific CAR, which was close to 1:1, indicating that the expression of bispecific CAR was as expected.

DETAILED DESCRIPTION

Figure 1:
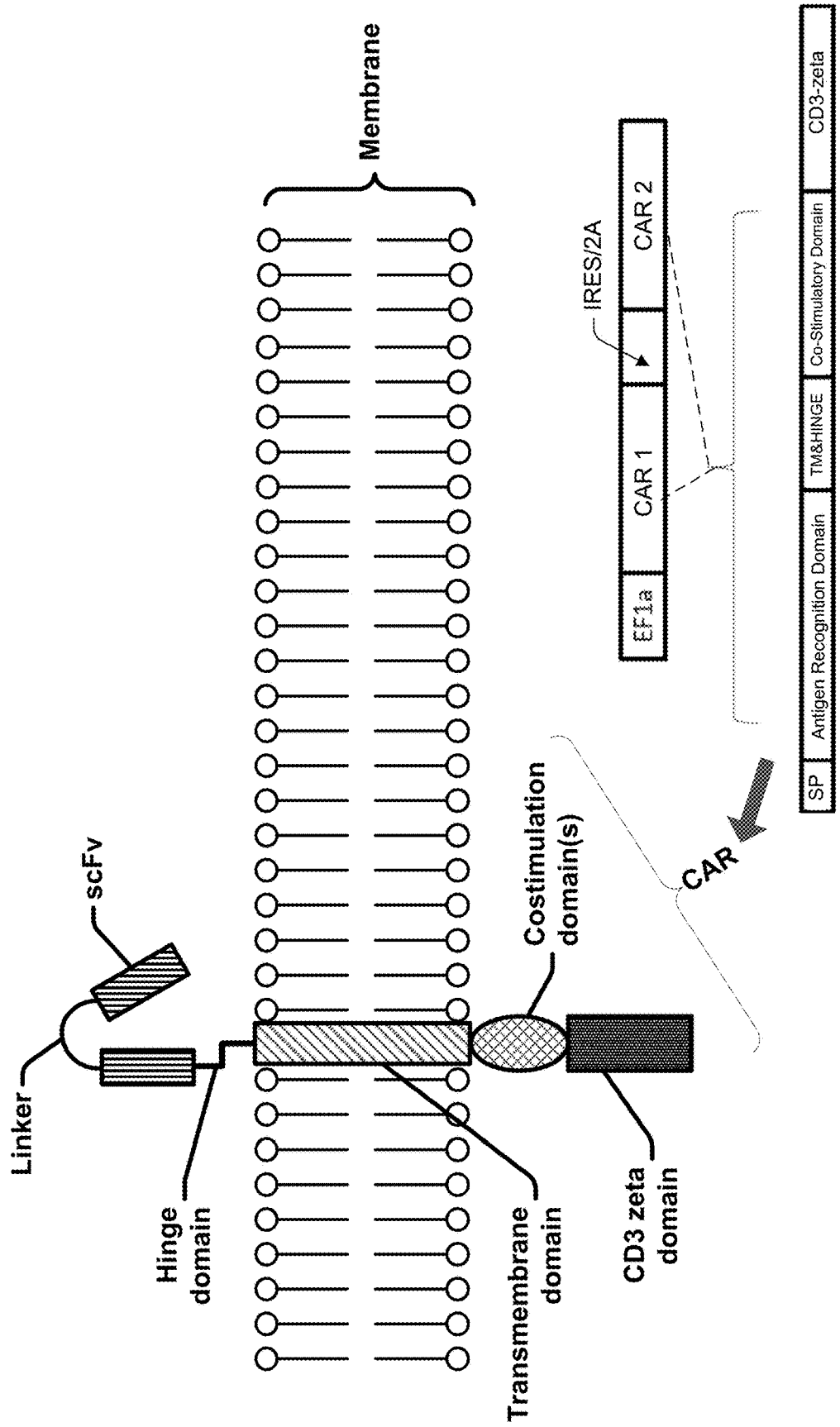
FIG. 1 is a schematic diagram of an exemplary CAR molecule and a portion of the cell membrane.
Figure 2:
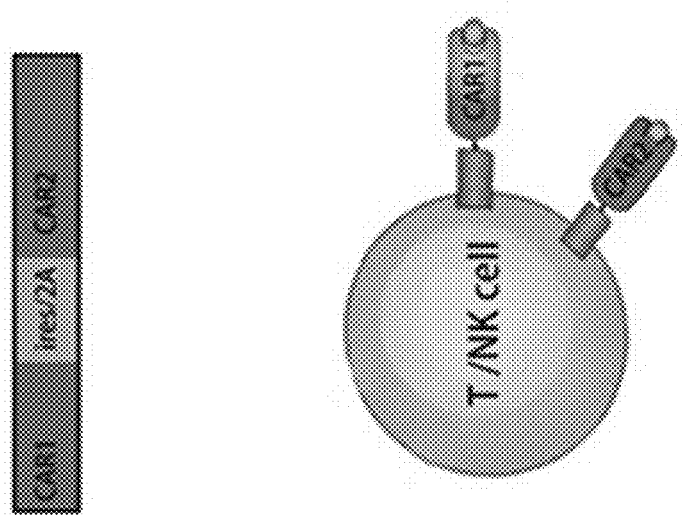
FIG. 2 is a schematic diagram of a nucleic acid construct including two CAR molecules and structures of a T cell having two different CAR molecules.
Figure 3:
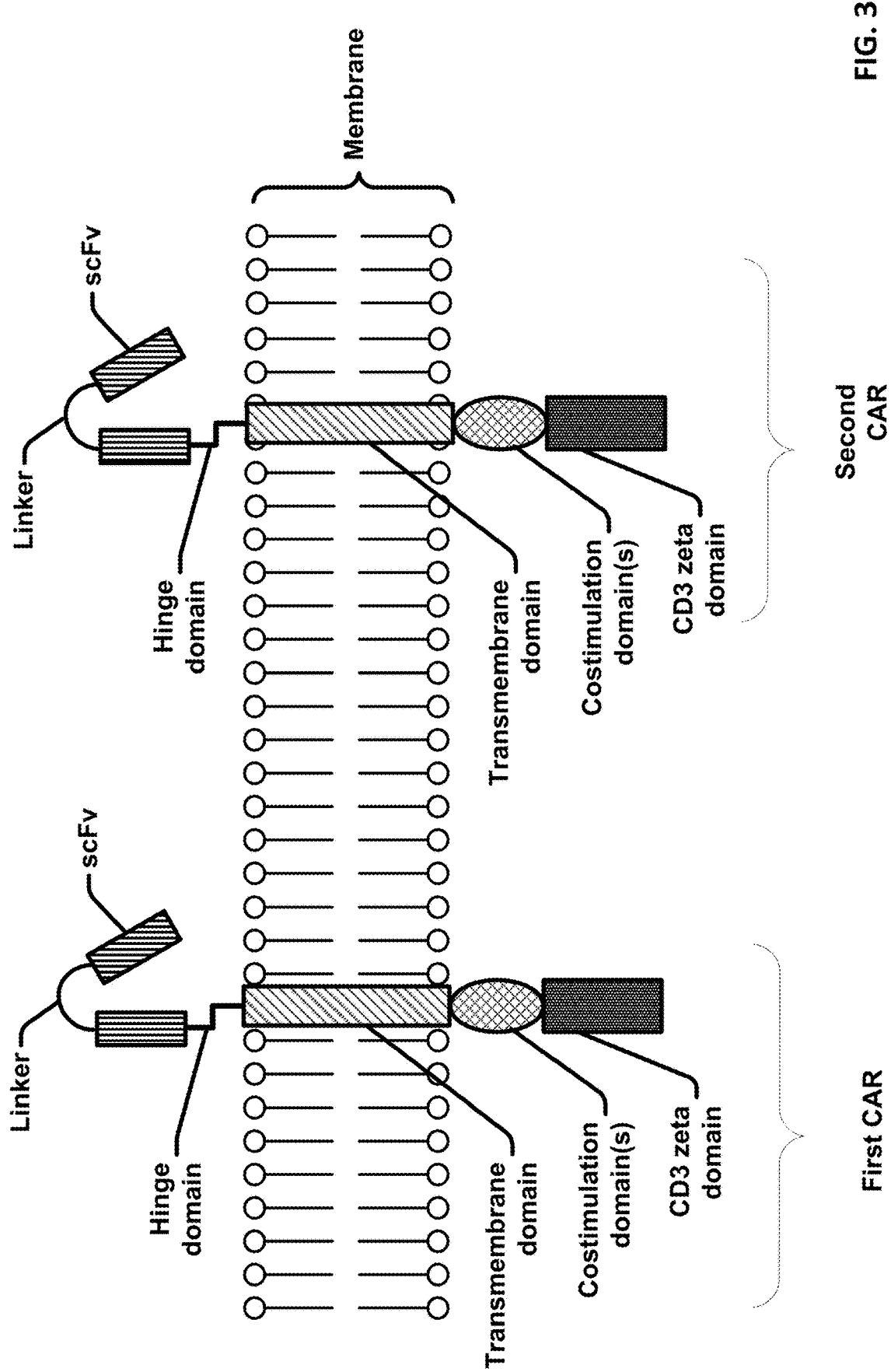
FIG. 3 is a schematic diagram showing an exemplary portion of a cell membrane comprising two CAR molecules.
Figure 4:
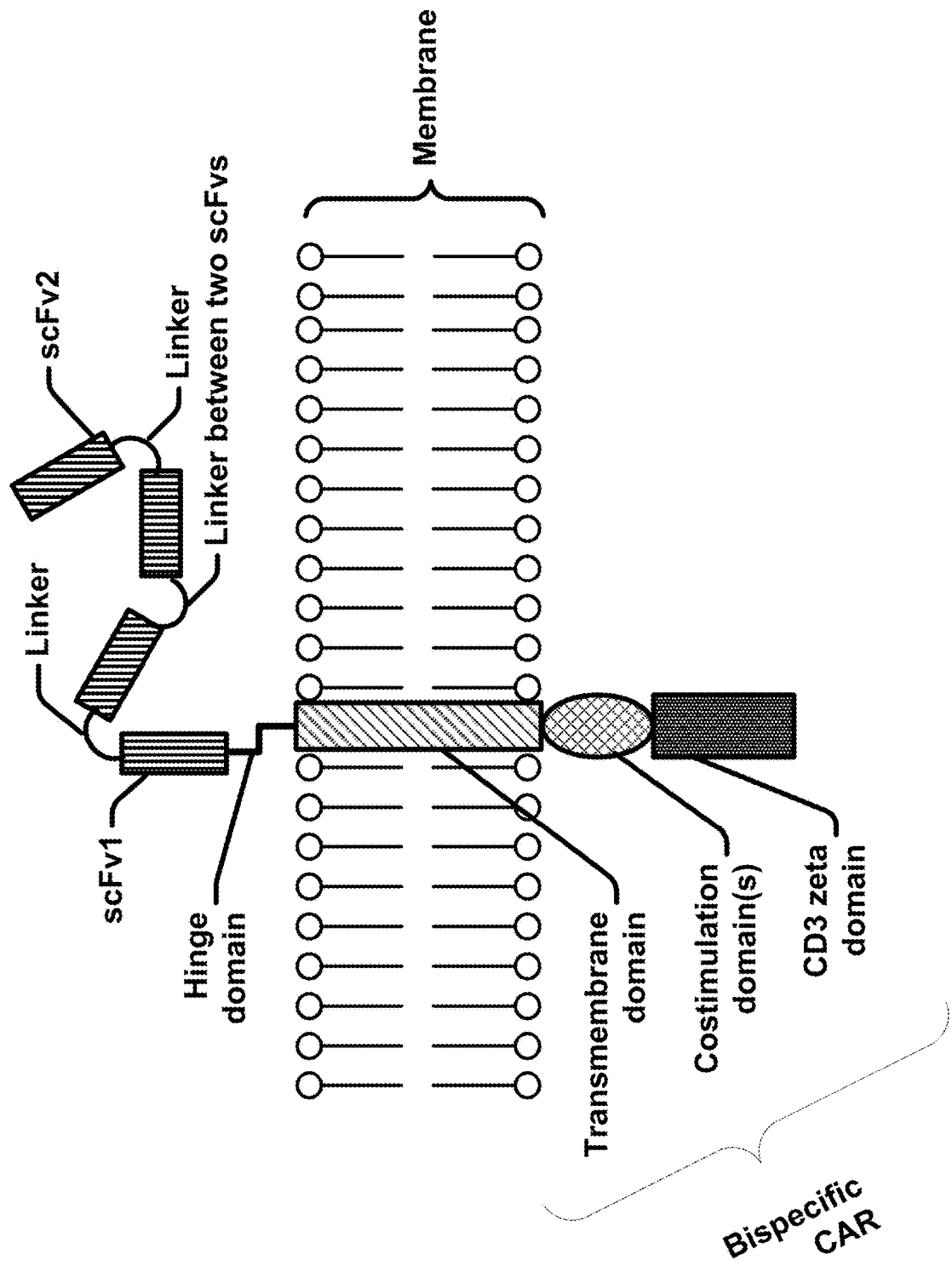
FIG. 4 is a schematic diagram showing an exemplary portion of a cell membrane comprising a bispecific CAR molecule.
Figure 5:
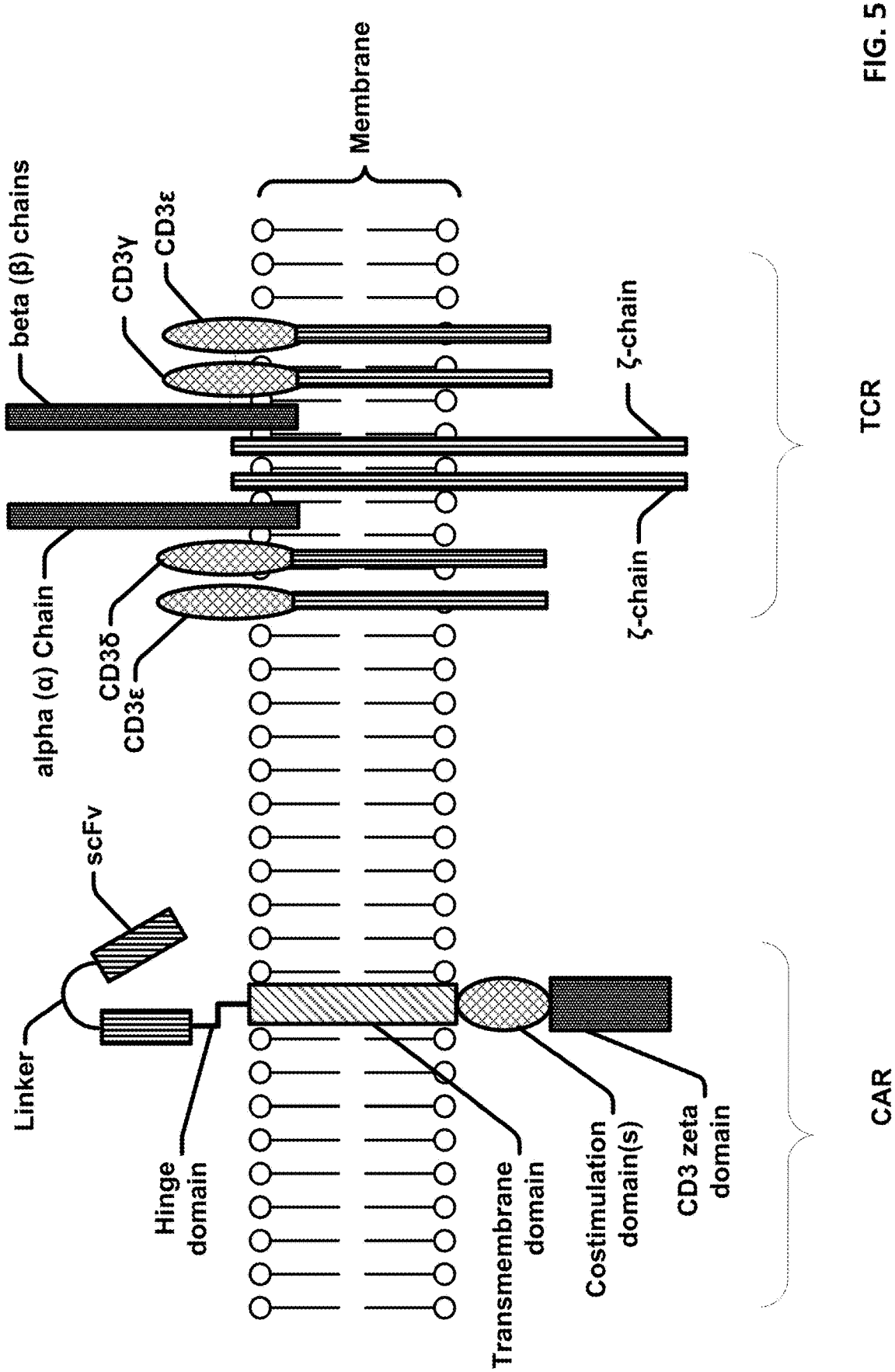
FIG. 5 is a schematic diagram showing an exemplary portion of a cell membrane comprising a bispecific CAR molecule and a T cell receptor (TCR).

Unless defined otherwise, all technical and scientific terms used herein have the same meaning as commonly understood by those of ordinary skill in the art to which the disclosure belongs. Although any method and material similar or equivalent to those described herein can be used in the practice or testing of the present disclosure, preferred methods and materials are described. For the purposes of the present disclosure, the following terms are defined below.

The articles "a" and "an" are used herein to refer to one or to more than one (i.e., to at least one) of the grammatical object of the article. By way of example, "an element" means one element or more than one element.

By "about" is meant a quantity, level, value, number, frequency, percentage, dimension, size, amount, weight or length that varies by as much as 20, 15, 10, 9, 8, 7, 6, 5, 4, 3, 2 or 1% to a reference quantity, level, value, number, frequency, percentage, dimension, size, amount, weight or length.

The term "activation," as used herein, refers to the state of a cell that has been sufficiently stimulated to induce detectable cellular proliferation. Activation can also be associated with induced cytokine production and detectable effector functions. The term "activated T cells" refers to, among other things, T cells that are undergoing cell division.

The term "antibody" is used in the broadest sense and refers to monoclonal antibodies (including full length monoclonal antibodies), polyclonal antibodies, multi-specific antibodies (e.g., bispecific antibodies), and antibody fragments so long as they exhibit the desired biological activity or function. The antibodies in the present disclosure may exist in a variety of forms including, for example, polyclonal antibodies; monoclonal antibodies; Fv, Fab, Fab', and F (ab') 2 fragments; as well as single chain antibodies and humanized antibodies (Harlow et al., 1999, In: Using Antibodies: A Laboratory Manual, Cold Spring Harbor Laboratory Press, NY; Harlow et al., 1989, In: Antibodies: A Laboratory Manual, Cold Spring Harbor, New York; Houston et al., 1988, Proc. Natl. Acad. Sci. USA 85:5879-5883; Bird et al., 1988, Science 242:423-426).

The term "antibody fragments" refers to a portion of a full-length antibody, for example, the antigen binding or variable region of the antibody. Other examples of antibody fragments include Fab, Fab', F (ab') 2, and Fv fragments; diabodies; linear antibodies; single-chain antibody molecules; and multi-specific antibodies formed from antibody fragments.

The term "Fv" refers to the minimum antibody fragment which contains a complete antigen-recognition and -binding site. This fragment consists of a dimer of one heavy- and one light-chain variable region domain in tight, non-covalent association. From the folding of these two domains emanates six hypervariable loops (3 loops each from the H and L chain) that contribute amino acid residues for antigen binding and confer antigen binding specificity to the antibody. However, even a single variable domain (or half of an Fv including only three complementarity determining regions (CDRs) specific for an antigen) has the ability to recognize and bind antigen, although at a lower affinity than the entire binding site (the dimer).

An "antibody heavy chain," as used herein, refers to the larger of the two types of polypeptide chains present in all antibody molecules in their naturally occurring conformations. An "antibody light chain," as used herein, refers to the smaller of the two types of polypeptide chains present in all antibody molecules in their naturally occurring conformations. K and λ light chains refer to the two major antibody light chain isotypes.

The term "synthetic antibody" refers to an antibody which is generated using recombinant DNA technology, such as, for example, an antibody expressed by a bacteriophage. The term also includes an antibody which has been generated by the synthesis of a DNA molecule encoding the antibody and the expression of the DNA molecule to obtain the antibody or to obtain an amino acid encoding the antibody. The synthetic DNA is obtained using technology that is available and well known in the art.

The term "antigen" refers to a molecule that provokes an immune response, which may involve either antibody production, or the activation of specific immunologically-competent cells, or both. Antigens include any macromolecule, including all proteins or peptides, or molecules derived from recombinant or genomic DNA. For example, DNA including a nucleotide sequence or a partial nucleotide sequence encoding a protein or peptide that elicits an immune response, and therefore, encodes an "antigen" as the term is used herein. An antigen need not be encoded solely by a full-length nucleotide sequence of a gene. An antigen can be generated, synthesized or derived from a biological sample including a tissue sample, a tumor sample, a cell, or a biological fluid.

The term "anti-tumor effect" as used herein, refers to a biological effect associated with a decrease in tumor volume, a decrease in the number of tumor cells, a decrease in the number of metastases, decrease in tumor cell proliferation, decrease in tumor cell survival, an increase in life expectancy of a subject having tumor cells, or amelioration of various physiological symptoms associated with the cancerous condition. An "anti-tumor effect" can also be manifested by the ability of the peptides, polynucleotides, cells, and antibodies in the prevention of the occurrence of tumor in the first place.

The term "auto-antigen" refers to an endogenous antigen mistakenly recognized by the immune system as being foreign. Auto-antigens include cellular proteins, phosphoproteins, cellular surface proteins, cellular lipids, nucleic acids, glycoproteins, including cell surface receptors.

The term "autologous" is used to describe a material derived from a subject which is subsequently re-introduced into the same subject.

The term "allogeneic" is used to describe a graft derived from a different subject of the same species. As an example, a donor subject may be a related or unrelated to the recipient subject, but the donor subject has immune system markers which are similar to the recipient subject.

The term "xenogeneic" is used to describe a graft derived from a subject of a different species. As an example, the donor subject is from a different species than a recipient subject, and the donor subject and the recipient subject can be genetically and immunologically incompatible.

The term "cancer" is used to refer to a disease characterized by the rapid and uncontrolled growth of aberrant cells. Cancer cells can spread locally or through the bloodstream and lymphatic system to other parts of the body. Examples of various cancers include breast cancer, prostate cancer, ovarian cancer, cervical cancer, skin cancer, pancreatic cancer, colorectal cancer, renal cancer, liver cancer, brain cancer, lymphoma, leukemia, lung cancer, and the like.

Throughout this specification, unless the context requires otherwise, the words "comprise," "includes" and "including" will be understood to imply the inclusion of a stated step or element or group of steps or elements but not the exclusion of any other step or element or group of steps or elements.

The phrase "consisting of" is meant to include, and is limited to, whatever follows the phrase "consisting of." Thus, the phrase "consisting of" indicates that the listed elements are required or mandatory and that no other elements may be present.

The phrase "consisting essentially of" is meant to include any element listed after the phrase and can include other elements that do not interfere with or contribute to the activity or action specified in the disclosure for the listed elements. Thus, the phrase "consisting essentially of" indicates that the listed elements are required or mandatory, but that other elements are optional and may or may not be present depending upon whether or not they affect the activity or action of the listed elements.

The terms "complementary" and "complementarity" refer to polynucleotides (i.e., a sequence of nucleotides) related by the base-pairing rules. For example, the sequence "A-G-T," is complementary to the sequence "T-C-A." Complementarity may be "partial," in which only some of the nucleic acids' bases are matched according to the base pairing rules, or there may be "complete" or "total" complementarity between the nucleic acids. The degree of complementarity between nucleic acid strands has significant effects on the efficiency and strength of hybridization between nucleic acid strands.

The term "corresponds to" or "corresponding to" refers to (a) a polynucleotide having a nucleotide sequence that is substantially identical or complementary to all or a portion of a reference polynucleotide sequence or encoding an amino acid sequence identical to an amino acid sequence in a peptide or protein; or (b) a peptide or polypeptide having an amino acid sequence that is substantially identical to a sequence of amino acids in a reference peptide or protein.

The term "co-stimulatory ligand," refers to a molecule on an antigen presenting cell (e.g., an APC, dendritic cell, B cell, and the like) that specifically binds a cognate co-stimulatory molecule on a T cell, thereby providing a signal which, in addition to the primary signal provided by, for instance, binding of a TCR/CD3 complex with an MHC molecule loaded with peptide, mediates a T cell response, including at least one of proliferation, activation, differentiation, and other cellular responses. A co-stimulatory ligand can include B7-1 (CD80), B7-2 (CD86), PD-L1, PD-L2, 4-1BBL, OX40L, inducible co-stimulatory ligand (ICOS-L), intercellular adhesion molecule (ICAM), CD30L, CD40, CD70, CD83, HLA-G, MICA, MICB, HVEM, lymphotoxin beta receptor, 3/TR6, ILT3, ILT4, HVEM, a ligand for CD7, an agonist or antibody that binds the Toll ligand receptor, and a ligand that specifically binds with B7-H3. A co-stimulatory ligand also includes, inter alia, an agonist or an antibody that specifically binds with a co-stimulatory molecule present on a T cell, such as CD27, CD28, 4-1BB, OX40, CD30, CD40, PD-1, ICOS, lymphocyte function-associated antigen-1 (LFA-1), CD2, CD7, LIGHT, NKG2C, B7-H3, and a ligand that specifically binds CD83.

The term "co-stimulatory molecule" refers to the cognate binding partner on a T cell that specifically binds with a co-stimulatory ligand, thereby mediating a co-stimulatory response by the T cell, such as proliferation. Co-stimulatory molecules include an MHC class I molecule, BTLA, and a Toll-like receptor.

The term "co-stimulatory signal" refers to a signal, which in combination with a primary signal, such as TCR/CD3 ligation, leads to T cell proliferation and/or upregulation or downregulation of key molecules.

The terms "disease" and "condition" may be used interchangeably or may be different in that the particular malady or condition may not have a known causative agent (so that etiology has not yet been worked out), and it is therefore not yet recognized as a disease but only as an undesirable condition or syndrome, wherein a more or less specific set of symptoms have been identified by clinicians. The term "disease" is a state of health of a subject wherein the subject cannot maintain homeostasis, and wherein if the disease is not ameliorated then the subject's health continues to deteriorate. In contrast, a "disorder" in a subject is a state of health in which the animal is able to maintain homeostasis, but in which the animal's state of health is less favorable than it would be in the absence of the disorder. Left untreated, a disorder does not necessarily cause a further decrease in the animal's state of health.

The term "effective" refers to adequate to accomplish a desired, expected, or intended result. For example, an "effective amount" in the context of treatment may be an amount of a compound sufficient to produce a therapeutic or prophylactic benefit.

The term "encoding" refers to the inherent property of specific sequences of nucleotides in a polynucleotide, such as a gene, a cDNA, or an mRNA, to serve as a template for synthesis of other polymers and macromolecules in biological processes having either a defined sequence of nucleotides (i.e., rRNA, tRNA and mRNA) or a defined sequence of amino acids and the biological properties resulting therefrom. Thus, a gene encodes a protein if transcription and translation of mRNA corresponding to that gene produces the protein in a cell or other biological system. Both the coding strand, the nucleotide sequence of which is identical to the mRNA sequence (except that a "T" is replaced by a "U") and is usually provided in sequence listings, and the non-coding strand, used as the template for transcription of a gene or cDNA, can be referred to as encoding the protein or other product of that gene or cDNA.

The term "exogenous" refers to a molecule that does not naturally occur in a wild-type cell or organism but is typically introduced into the cell by molecular biological techniques. Examples of exogenous polynucleotides include vectors, plasmids, and/or man-made nucleic acid constructs encoding the desired protein. With regard to polynucleotides and proteins, the term "endogenous" or "native" refers to naturally-occurring polynucleotide or amino acid sequences that may be found in a given wild-type cell or organism. Also, a particular polynucleotide sequence that is isolated from a first organism and transferred to a second organism by molecular biological techniques is typically considered an "exogenous" polynucleotide or amino acid sequence with respect to the second organism. In specific embodiments, polynucleotide sequences can be "introduced" by molecular biological techniques into a microorganism that already contains such a polynucleotide sequence, for instance, to create one or more additional copies of an otherwise naturally-occurring polynucleotide sequence, and thereby facilitate overexpression of the encoded polypeptide.

The term "expression" refers to the transcription and/or translation of a particular nucleotide sequence driven by its promoter.

The term "expression vector" refers to a vector including a recombinant polynucleotide including expression control (regulatory) sequences operably linked to a nucleotide sequence to be expressed. An expression vector includes sufficient cis-acting elements for expression; other elements for expression can be supplied by the host cell or in an in vitro expression system. Expression vectors include all those known in the art, such as cosmids, plasmids (e.g., naked or contained in liposomes) and viruses (e.g., lentiviruses, retroviruses, adenoviruses, and adeno-associated viruses) that incorporate the recombinant polynucleotide.

The term "homologous" refers to sequence similarity or sequence identity between two polypeptides or between two polynucleotides when a position in both of the two compared sequences is occupied by the same base or amino acid monomer subunit, e.g., if a position in each of two DNA molecules is occupied by adenine, then the molecules are homologous at that position. The percent of homology between two sequences is a function of the number of matching or homologous positions shared by the two sequences divided by the number of positions compared ×100. For example, if 6 of 10 of the positions in two sequences are matched or homologous, then the two sequences are 60% homologous. By way of example, the DNA sequences ATTGCC and TATGGC share 50% homology. A comparison is made when two sequences are aligned to give maximum homology.

The term "immunoglobulin" or "Ig," refers to a class of proteins, which function as antibodies. The five members included in this class of proteins are IgA, IgG, IgM, IgD, and IgE. IgA is the primary antibody that is present in body secretions, such as saliva, tears, breast milk, gastrointestinal secretions and mucus secretions of the respiratory and genitourinary tracts. IgG is the most common circulating antibody. IgM is the main immunoglobulin produced in the primary immune response in most subjects. It is the most efficient immunoglobulin in agglutination, complement fixation, and other antibody responses, and is important in defense against bacteria and viruses. IgD is the immunoglobulin that has no known antibody function but may serve as an antigen receptor. IgE is the immunoglobulin that mediates immediate hypersensitivity by causing the release of mediators from mast cells and basophils upon exposure to the allergen.

The term "isolated" refers to a material that is substantially or essentially free from components that normally accompany it in its native state. The material can be a cell or a macromolecule such as a protein or nucleic acid. For example, an "isolated polynucleotide," as used herein, refers to a polynucleotide, which has been purified from the sequences which flank it in a naturally-occurring state, e.g., a DNA fragment which has been removed from the sequences that are normally adjacent to the fragment. Alternatively, an "isolated peptide" or an "isolated polypeptide" and the like, as used herein, refer to in vitro isolation and/or purification of a peptide or polypeptide molecule from its natural cellular environment, and from association with other components of the cell.

The term "substantially purified" refers to a material that is substantially free from components that are normally associated with it in its native state. For example, a substantially purified cell refers to a cell that has been separated from other cell types with which it is normally associated in its naturally occurring or native state. In some instances, a population of substantially purified cells refers to a homogenous population of cells. In other instances, this term refers simply to a cell that has been separated from the cells with which they are naturally associated in their natural state. In embodiments, the cells are cultured in vitro. In embodiments, the cells are not cultured in vitro.

In the context of the present disclosure, the following abbreviations for the commonly occurring nucleic acid bases are used. "A" refers to adenosine, "C" refers to cytosine, "G" refers to guanosine, "T" refers to thymidine, and "U" refers to uridine.

Unless otherwise specified, a "nucleotide sequence encoding an amino acid sequence" includes all nucleotide sequences that are degenerate versions of each other and that encode the same amino acid sequence. The phrase nucleotide sequence that encodes a protein or an RNA may also include introns to the extent that the nucleotide sequence encoding the protein may in some version contain an intron(s).

The term "lentivirus" refers to a genus of the Retroviridae family. Lentiviruses are unique among the retroviruses in being able to infect non-dividing cells; they can deliver a significant amount of genetic information into the DNA of the host cell, so they are one of the most efficient methods of a gene delivery vector. Moreover, the use of lentiviruses enables integration of the genetic information into the host chromosome resulting in stably transduced genetic information. HIV, SIV, and FIV are all examples of lentiviruses. Vectors derived from lentiviruses offer the means to achieve significant levels of gene transfer in vivo.

The term "modulating," refers to mediating a detectable increase or decrease in the level of a response in a subject compared with the level of a response in the subject in the absence of a treatment or compound, and/or compared with the level of a response in an otherwise identical but untreated subject. The term encompasses perturbing and/or affecting a native signal or response thereby mediating a beneficial therapeutic response in a subject, preferably, a human.

Nucleic acid is "operably linked" when it is placed into a functional relationship with another nucleic acid sequence. For example, DNA for a presequence or secretory leader is operably linked to DNA for a polypeptide if it is expressed as a preprotein that participates in the secretion of the polypeptide; a promoter or enhancer is operably linked to a coding sequence if it affects the transcription of the sequence; or a ribosome binding site is operably linked to a coding sequence if it is positioned so as to facilitate translation.

The term "under transcriptional control" refers to a promoter being operably linked to and in the correct location and orientation in relation to a polynucleotide to control (regulate) the initiation of transcription by RNA polymerase and expression of the polynucleotide.

The term "overexpressed" tumor antigen or "overexpression" of the tumor antigen is intended to indicate an abnormal level of expression of the tumor antigen in a cell from a disease area such as a solid tumor within a specific tissue or organ of the patient relative to the level of expression in a normal cell from that tissue or organ. Patients having solid tumor or a hematological malignancy characterized by overexpression of the tumor antigen can be determined by standard assays known in the art.

Solid tumors are abnormal masses of tissue that usually do not contain cysts or liquid areas. Solid tumors can be benign or malignant. Different types of solid tumors are named for the type of cells that form them (such as sarcomas, carcinomas, and lymphomas). Examples of solid tumors, such as sarcomas and carcinomas, include fibrosarcoma, myxosarcoma, liposarcoma, chondrosarcoma, osteosarcoma, synovioma, mesothelioma, Ewing's tumor, leiomyosarcoma, rhabdomyosarcoma, colon carcinoma, lymphoid malignancy, pancreatic cancer, breast cancer, lung cancers, ovarian cancer, prostate cancer, hepatocellular carcinoma, squamous cell carcinoma, basal cell carcinoma, adenocarcinoma, sweat gland carcinoma, medullary thyroid carcinoma, papillary thyroid carcinoma, pheochromocytomas sebaceous gland carcinoma, papillary carcinoma, papillary adenocarcinomas, medullary carcinoma, bronchogenic carcinoma, renal cell carcinoma, hepatoma, bile duct carcinoma, choriocarcinoma, Wilms' tumor, cervical cancer, testicular tumor, seminoma, bladder carcinoma, melanoma, and CNS tumors (such as a glioma (such as brainstem glioma and mixed gliomas), glioblastoma (also known as glioblastoma multiforme), astrocytoma, CNS lymphoma, germinoma, medulloblastoma, Schwannoma craniopharyogioma, ependymoma, pinealoma, hemangioblastoma, acoustic neuroma, oligodendroglioma, menangioma, neuroblastoma, retinoblastoma, and brain metastases).

A solid tumor antigen is an antigen expressed on a solid tumor. In embodiments, solid tumor antigens are also expressed at low levels on healthy tissue. Examples of solid tumor antigens and their related disease tumors are provided in Table 1.

TABLE 1

| Solid Tumor antigen | Disease tumor |
|---|---|
| PRLR | Breast Cancer |
| CLCA1 | colorectal Cancer |
| MUC12 | colorectal Cancer |
| GUCY2C | colorectal Cancer |
| GPR35 | colorectal Cancer |
| CR1L | Gastric Cancer |
| MUC 17 | Gastric Cancer |
| TMPRSS11B | esophageal Cancer |
| MUC21 | esophageal Cancer |
| TMPRSS11E | esophageal Cancer |
| CD207 | bladder Cancer |
| SLC30A8 | pancreatic Cancer |
| CFC1 | pancreatic Cancer |
| SLC12A3 | Cervical Cancer |
| SSTR1 | Cervical tumor |
| GPR27 | Ovary tumor |
| FZD10 | Ovary tumor |
| TSHR | Thyroid Tumor |
| SIGLEC15 | Urothelial cancer |
| SLC6A3 | Renal cancer |
| KISS1R | Renal cancer |
| QRFPR | Renal cancer: |
| GPR119 | Pancreatic cancer |
| CLDN6 | Endometrial cancer/Urothelial cancer |
| UPK2 | Urothelial cancer (including bladder cancer) |
| ADAM12 | Breast cancer, pancreatic cancer and the like |
| SLC45A3 | Prostate cancer |
| ACPP | Prostate cancer |
| MUC21 | Esophageal cancer |
| MUC16 | Ovarian cancer |
| MS4A12 | Colorectal cancer |
| ALPP | Endometrial cancer |
| CEA | Colorectal carcinoma |
| EphA2 | Glioma |
| FAP | Mesotelioma |
| GPC3 | Lung squamous cell carcinoma |
| IL13-Rα2 | Glioma |
| Mesothelin | Metastatic cancer |
| PSMA | Prostate cancer |
| ROR1 | Breast lung carcinoma |
| VEGFR-II | Metastatic cancer |
| GD2 | Neuroblastoma |
| FR-α | Ovarian carcinoma |
| ErbB2 | Carcinomasb |
| EpCAM | Carcinomasa |
| EGFRvIII | Glioma - Glioblastoma |
| EGFR | Glioma - NSCL cancer |
| tMUC 1 | Cholangiocarcinoma, Pancreatic cancer, Breast Cancer |
| PSCA | pancreas, stomach, or prostate cancer |

The term "parenteral administration" of a composition includes, e.g., subcutaneous (s.c.), intravenous (i.v.), intramuscular (i.m.), intrasternal injection, or infusion techniques.

The terms "patient," "subject," and "individual," and the like are used interchangeably herein and refer to any human, or animal, amenable to the methods described herein. In certain non-limiting embodiments, the patient, subject, or individual is a human or animal. In embodiments, the term "subject" is intended to include living organisms in which an immune response can be elicited (e.g., mammals). Examples of subjects include humans, and animals, such as dogs, cats, mice, rats, and transgenic species thereof.

A subject in need of treatment or in need thereof includes a subject having a disease, condition, or disorder that needs to be treated. A subject in need thereof also includes a subject that needs treatment for prevention of a disease, condition, or disorder.

The term "polynucleotide" or "nucleic acid" refers to mRNA, RNA, CRNA, rRNA, cDNA or DNA. The term typically refers to a polymeric form of nucleotides of at least 10 bases in length, either ribonucleotides or deoxynucleotides or a modified form of either type of nucleotide. The term includes all forms of nucleic acids including single and double-stranded forms of nucleic acids.

The terms "polynucleotide variant" and "variant" and the like refer to polynucleotides displaying substantial sequence identity with a reference polynucleotide sequence or polynucleotides that hybridize with a reference sequence under stringent conditions that are defined hereinafter. These terms also encompass polynucleotides that are distinguished from a reference polynucleotide by the addition, deletion or substitution of at least one nucleotide. Accordingly, the terms "polynucleotide variant" and "variant" include polynucleotides in which one or more nucleotides have been added or deleted or replaced with different nucleotides. In this regard, it is well understood in the art that certain alterations inclusive of mutations, additions, deletions, and substitutions can be made to a reference polynucleotide whereby the altered polynucleotide retains the biological function or activity of the reference polynucleotide or has increased activity in relation to the reference polynucleotide (i.e., optimized). Polynucleotide variants include, for example, polynucleotides having at least 50% (and at least 51% to at least 99% and all integer percentages in between, e.g., 90%, 95%, or 98%) sequence identity with a reference polynucleotide sequence described herein. The terms "polynucleotide variant" and "variant" also include naturally-occurring allelic variants and orthologs.

The terms "polypeptide," "polypeptide fragment," "peptide," and "protein" are used interchangeably herein to refer to a polymer of amino acid residues and to variants and synthetic analogues of the same. Thus, these terms apply to amino acid polymers in which one or more amino acid residues are synthetic non-naturally occurring amino acids, such as a chemical analogue of a corresponding naturally occurring amino acid, as well as to naturally-occurring amino acid polymers. In certain aspects, polypeptides may include enzymatic polypeptides, or "enzymes," which typically catalyze (i.e., increase the rate of) various chemical reactions.

The term "polypeptide variant" refers to polypeptides that are distinguished from a reference polypeptide sequence by the addition, deletion, or substitution of at least one amino acid residue. In certain embodiments, a polypeptide variant is distinguished from a reference polypeptide by one or more substitutions, which may be conservative or non-conservative. In certain embodiments, the polypeptide variant comprises conservative substitutions and, in this regard, it is well understood in the art that some amino acids may be changed to others with broadly similar properties without changing the nature of the activity of the polypeptide. Polypeptide variants also encompass polypeptides in which one or more amino acids have been added or deleted or replaced with different amino acid residues.

The term "promoter" refers to a DNA sequence recognized by the synthetic machinery of the cell or introduced synthetic machinery, required to initiate the specific transcription of a polynucleotide sequence. The term "expression control (regulatory) sequences" refers to DNA sequences necessary for the expression of an operably linked coding sequence in a particular host organism. The control sequences that are suitable for prokaryotes, for example, include a promoter, optionally an operator sequence, and a ribosome binding site. Eukaryotic cells are known to utilize promoters, polyadenylation signals, and enhancers.

The term "bind," "binds," or "interacts with" refers to a molecule recognizing and adhering to a second molecule in a sample or organism but does not substantially recognize or adhere to other structurally unrelated molecules in the sample. The term "specifically binds," as used herein with respect to an antibody, refers to an antibody which recognizes a specific antigen, but does not substantially recognize or bind other molecules in a sample. For example, an antibody that specifically binds an antigen from one species may also bind that antigen from one or more species. But, such cross-species reactivity does not itself alter the classification of an antibody as specific. In another example, an antibody that specifically binds an antigen may also bind different allelic forms of the antigen. However, such cross reactivity does not itself alter the classification of an antibody as specific. In some instances, the terms "specific binding" or "specifically binding," can be used in reference to the interaction of an antibody, a protein, or a peptide with a second chemical species, to mean that the interaction is dependent upon the presence of a particular structure (e.g., an antigenic determinant or epitope) on the chemical species; for example, an antibody recognizes and binds a specific protein structure rather than to any protein. If an antibody is specific for epitope "A," the presence of a molecule containing epitope A (or free, unlabeled A), in a reaction containing labeled "A" and the antibody, will reduce the amount of labeled A bound to the antibody.

By "statistically significant," it is meant that the result was unlikely to have occurred by chance. Statistical significance can be determined by any method known in the art. Commonly used measures of significance include the p-value, which is the frequency or probability with which the observed event would occur if the null hypothesis were true. If the obtained p-value is smaller than the significance level, then the null hypothesis is rejected. In simple cases, the significance level is defined at a p-value of 0.05 or less. A "decreased" or "reduced" or "lesser" amount is typically a "statistically significant" or a physiologically significant amount, and may include a decrease that is about 1.1, 1.2, 1.3, 1.4, 1.5, 1.6 1.7, 1.8, 1.9, 2, 2.5, 3, 3.5, 4, 4.5, 5, 6, 7, 8, 9, 10, 15, 20, 30, 40, or 50 or more times (e.g., 100, 500, 1000 times) (including all integers and decimal points in between and above 1, e.g., 1.5, 1.6, 1.7. 1.8, etc.) an amount or level described herein.

The term "stimulation," refers to a primary response induced by binding of a stimulatory molecule (e.g., a TCR/CD3 complex) with its cognate ligand thereby mediating a signal transduction event, such as signal transduction via the TCR/CD3 complex. Stimulation can mediate altered expression of certain molecules, such as downregulation of TGF-β, and/or reorganization of cytoskeletal structures.

The term "stimulatory molecule" refers to a molecule on a T cell that specifically binds a cognate stimulatory ligand present on an antigen presenting cell. For example, a functional signaling domain derived from a stimulatory molecule is the zeta chain associated with the T cell receptor complex. The stimulatory molecule includes a domain responsible for signal transduction.

The term "stimulatory ligand" refers to a ligand that when present on an antigen presenting cell (e.g., an APC, a dendritic cell, a B-cell, and the like.) can specifically bind with a cognate binding partner (referred to herein as a "stimulatory molecule") on a cell, for example a T cell, thereby mediating a primary response by the T cell, including activation, initiation of an immune response, proliferation, and similar processes. Stimulatory ligands are well-known in the art and encompass, inter alia, an MHC Class I molecule loaded with a peptide, an anti-CD3 antibody, a superagonist anti-CD28 antibody, and a superagonist anti-CD2 antibody.

The term "therapeutic" refers to a treatment and/or prophylaxis. A therapeutic effect is obtained by suppression, remission, or eradication of a disease state or alleviating the symptoms of a disease state.

The term "therapeutically effective amount" refers to the amount of the subject compound that will elicit the biological or medical response of a tissue, system, or subject that is being sought by the researcher, veterinarian, medical doctor or another clinician. The term "therapeutically effective amount" includes that amount of a compound that, when administered, is sufficient to prevent the development of, or alleviate to some extent, one or more of the signs or symptoms of the disorder or disease being treated. The therapeutically effective amount will vary depending on the compound, the disease and its severity and the age, weight, etc., of the subject to be treated.

The term "treat a disease" refers to the reduction of the frequency or severity of at least one sign or symptom of a disease or disorder experienced by a subject.

The term "transfected" or "transformed" or "transduced" refers to a process by which an exogenous nucleic acid is transferred or introduced into the host cell. A "transfected" or "transformed" or "transduced" cell is one which has been transfected, transformed, or transduced with exogenous nucleic acid. The cell includes the primary subject cell and its progeny.

The term "vector" refers to a polynucleotide that comprises an isolated nucleic acid and which can be used to deliver the isolated nucleic acid to the interior of a cell. Numerous vectors are known in the art including linear polynucleotides, polynucleotides associated with ionic or amphiphilic compounds, plasmids, and viruses. Thus, the term "vector" includes an autonomously replicating plasmid or a virus. The term also includes non-plasmid and non-viral compounds which facilitate the transfer of nucleic acid into cells, such as, for example, polylysine compounds, liposomes, and the like. Examples of viral vectors include adenoviral vectors, adeno-associated virus vectors, retroviral vectors, and others. For example, lentiviruses are complex retroviruses, which, in addition to the common retroviral genes gag, pol, and env, contain other genes with regulatory or structural function. Lentiviral vectors are well known in the art. Some examples of lentivirus include the Human Immunodeficiency Viruses: HIV-1, HIV-2, and the Simian Immunodeficiency Virus: SIV. Lentiviral vectors have been generated by multiply attenuating the HIV virulence genes, for example, the genes env, vif, vpr, vpu, and nef are deleted making the vector biologically safe.

Ranges: throughout this disclosure, various aspects of the disclosure can be presented in a range format. It should be understood that the description in range format is merely for convenience and brevity and should not be construed as an inflexible limitation on the scope of the disclosure. Accordingly, the description of a range should be considered to have specifically disclosed all the possible subranges as well as individual numerical values within that range. For example, description of a range such as from 1 to 6 should be considered to have specifically disclosed subranges such as from 1 to 3, from 1 to 4, from 1 to 5, from 2 to 4, from 2 to 6, from 3 to 6 etc., as well as individual numbers within that range, for example, 1, 2, 2.7, 3, 4, 5, 5.3, and 6. This applies regardless of the breadth of the range.

A "chimeric antigen receptor" (CAR) molecule is a recombinant polypeptide including at least an extracellular domain, a transmembrane domain and a cytoplasmic domain or intracellular domain. In embodiments, the domains of the CAR are on the same polypeptide chain, for example a chimeric fusion protein. In embodiments, the domains are on different polypeptide chains, for example the domains are not contiguous.

The extracellular domain of a CAR molecule includes an antigen binding domain. The antigen binding domain is for expanding and/or maintaining the modified cells, such as a CAR T cell or for killing a tumor cell, such as a solid tumor. In embodiments, the antigen binding domain for expanding and/or maintaining modified cells binds an antigen, for example, a cell surface molecule or marker, on the surface of a WBC. In embodiments, the WBC is a granulocyte, monocyte and or lymphocyte. In embodiments, the WBC is a lymphocyte, for example, a B cell. In embodiments, the WBC is a B cell. In embodiments, the cell surface molecule of a B cell includes CD19, CD22, CD20, BCMA, CD5, CD7, CD2, CD16, CD56, CD30, CD14, CD68, CD11b, CD18, CD169, CD1c, CD38, CD138, or CD13. In embodiments, the cell surface molecule of the B cell is CD19, CD20, CD22, or BCMA. In embodiments, the cell surface molecule of the B cell is CD19.

In embodiments, the antigen binding domain for killing a tumor, binds an antigen on the surface of a tumor, for example a tumor antigen or tumor marker. Tumor antigens are proteins that are produced by tumor cells that elicit an immune response, particularly T cell mediated immune responses. Tumor antigens are well known in the art and include, for example, tumor associated MUC1 (tMUC1), a glioma-associated antigen, carcinoembryonic antigen (CEA), β-human chorionic gonadotropin, alphafetoprotein (AFP), lectin-reactive AFP, thyroglobulin, RAGE-1, MN-CA IX, human telomerase reverse transcriptase, RU1, RU2 (AS), intestinal carboxyl esterase, mut hsp70-2, M-CSF, prostase, prostate-specific antigen (PSA), PAP, NY-ESO-1, LAGE-1a, p53, prostein, PSMA, Her2/neu, surviving, telomerase, prostate-carcinoma tumor antigen-1 (PCTA-1), MAGE, ELF2M, neutrophil elastase, ephrinB2, CD22, insulin growth factor (IGF)-I, IGF-II, IGF-I receptor, CD19, and mesothelin. For example, when the tumor antigen is CD19, the CAR thereof can be referred to as CD19CAR, which is a CAR molecule that includes a antigen binding domain that binds CD19.

In embodiments, the extracellular antigen binding domain of a CAR includes at least one scFv or at least a single domain antibody. As an example, there can be two scFvs on a CAR. The scFv includes a light chain variable (VL) region and a heavy chain variable (VH) region of a target antigen-specific monoclonal antibody joined by a flexible linker. Single chain variable region fragments can be made by linking light and/or heavy chain variable regions by using a short linking peptide (Bird et al., Science 242:423-426, 1988). An example of a linking peptide is the GS linker having the amino acid sequence (GGGGS) 3 (SEQ ID NO: 124), which bridges approximately 3.5 nm between the carboxy terminus of one variable region and the amino terminus of the other variable region. Linkers of other sequences have been designed and used (Bird et al., 1988, supra). In general, linkers can be short, flexible polypeptides and preferably comprised of about 20 or fewer amino acid residues. The single chain variants can be produced either recombinantly or synthetically. For synthetic production of scFv, an automated synthesizer can be used. For recombinant production of scFv, a suitable plasmid containing polynucleotide that encodes the scFv can be introduced into a suitable host cell, either eukaryotic, such as yeast, plant, insect or mammalian cells, or prokaryotic, such as $E.$ $coli.$ Polynucleotides encoding the scFv of interest can be made by routine manipulations such as ligation of polynucleotides. The resultant scFv can be isolated using standard protein purification techniques known in the art.

The cytoplasmic domain of the CAR molecules described herein includes one or more co-stimulatory domains and one or more signaling domains. The co-stimulatory and signaling domains function to transmit the signal and activate molecules, such as T cells, in response to antigen binding. The one or more co-stimulatory domains are derived from stimulatory molecules and/or co-stimulatory molecules, and the signaling domain is derived from a primary signaling domain, such as the CD3 zeta domain. In embodiments, the signaling domain further includes one or more functional signaling domains derived from a co-stimulatory molecule. In embodiments, the co-stimulatory molecules are cell surface molecules (other than antigens receptors or their ligands) that are required for activating a cellular response to an antigen.

In embodiments, the co-stimulatory domain includes the intracellular domain of CD27, CD28, 4-1BB, OX40, CD30, CD40, PD-1, ICOS, lymphocyte function-associated antigen-1 (LFA-1), CD2, CD7, LIGHT, NKG2C, B7-H3, a ligand that specifically binds with CD83, or any combination thereof. In embodiments, the signaling domain includes a CD3 zeta domain derived from a T cell receptor.

The CAR molecules described herein also include a transmembrane domain. The incorporation of a transmembrane domain in the CAR molecules stabilizes the molecule. In embodiments, the transmembrane domain of the CAR molecules is the transmembrane domain of a CD28 or 4-1BB molecule.

Between the extracellular domain and the transmembrane domain of the CAR, there may be incorporated a spacer domain. As used herein, the term "spacer domain" generally means any oligo-or polypeptide that functions to link the transmembrane domain to the extracellular domain and/or the cytoplasmic domain on the polypeptide chain. A spacer domain may include up to 300 amino acids, preferably 10 to 100 amino acids, and most preferably 25 to 50 amino acids.

The present disclosure describes nucleic acids encoding at least two different antigen binding domains. In embodiments, there is a first antigen binding domain that binds an antigen on the surface of a WBC, and there is a second antigen binding domain that binds an antigen on a tumor that is different from the antigen on the surface of a WBC. The first antigen binding domain functions to expand the cells that it is introduced into, while the second antigen binding domain functions to inhibit the growth of or kill tumor cells containing the target tumor antigen upon binding to the target antigen. In embodiments, a nucleic acid described herein encodes both the first and second antigen binding domains on the same nucleic acid molecule. In embodiments, the two antigen binding domains are encoded by two separate nucleic acid molecules. For example, a first nucleic acid encodes a first antigen binding domain and a second nucleic acid encodes a second antigen binding domain.

In embodiments, the present disclosure describes nucleic acids encoding a first antigen binding domain of a binding molecule and a second antigen binding domain of a binding molecule, wherein the first antigen binding domain binds a cell surface molecule of a WBC, and the second antigen binding domain binds an antigen different from the cell surface molecule of the WBC. In embodiments, the first antigen binding domain binds a cell surface antigen of a B cell or a B cell marker. In embodiments, the second binding domain does not bind a B cell marker. In embodiments, the second binding domain includes a scFv comprising an amino acid sequence of SEQ ID No: 264 or 265. For example, the second antigen binding domain is on a CAR having one of the amino acid sequences of SEQ ID Nos: 271-277.

In embodiments, the first and second antigen binding domains are on two different binding molecules (first and second binding molecules) such as a first CAR and a second CAR. As an example, a first CAR includes an extracellular binding domain that binds a marker on the surface of a B cell, and a second CAR includes an extracellular binding domain that binds a target antigen of a tumor cell. In embodiments, the first CAR and second CAR are encoded by different nucleic acids. In embodiments, the first CAR and second CAR are two different binding molecules but are encoded by a single nucleic acid.

In embodiments, the two different antigen binding domains can be on the same binding molecule, for example on a bispecific CAR, and encoded by a single nucleic acid. In embodiments, the bispecific CAR can have two different scFv molecules joined together by linkers. Examples of the bispecific CAR are provided in Table 19.

vector contains the nucleic acid encoding the first CAR and second CAR or TCR (containing the second antigen binding domain). In embodiments, a first vector contains the first nucleic acid encoding a first CAR, and a second vector contains the nucleic acid encoding the second CAR or TCR. In embodiments, the vector includes the nucleic acid encoding a bispecific CAR including at least the two different antigen binding domains. In embodiments, the vectors including the nucleic acids described herein are lentiviral vectors.

Moreover, the present disclosure describes modified cells comprising the nucleic acids or vectors described above. The cells have been introduced with the nucleic acids or vectors described herein and express at least one or more different antigen binding domains. In embodiments, the cells express one antigen binding domain. In embodiments, the cells include a first antigen binding domain and a second antigen binding domain, wherein the first antigen binding domain binds a cell surface molecule of a WBC, and the second antigen binding domain binds an antigen different from the cell surface molecule of a WBC. In embodiments, the second antigen binding domain binds a tumor antigen. In embodiments, the cells are modified T cells. In embodiments, the modified T cells are CAR T cells including one or more nucleic acids encoding a first antigen binding domain and/or a second antigen binding domain. In embodi-

TABLE 19

| | Molecule | | | | | | |
|---|---|---|---|---|---|---|---|
| Domain | Variable domain 1 | Linker 1 | Variable domain 3 | Linker 2 | Variable domain 5 | Linker3 | Variable domain 7 |
| Example 1 (See Example in FIG. 53) | Anti-TSHR-VL | 3*GGG GS linker | Anti-TSHR-VH | 4*GGG GS bispecific CAR linker | humanized-anti CD19-VH | 3*GGG GS linker | humanized-anti CD19-VL |
| Example 2 | Anti-TSHR-VH | 3*GGG GS linker | Anti-TSHR-VL | 4*GGG GS bispecific CAR linker | humanized anti CD19-VL | 3*GGG GS linker | humanized anti CD19-VH |
| Example 3 | Tumor associated MUC1 scFv-1 or 2 VL | 3*GGG GS linker | Tumor associated MUC1 scFv-1 or 2 VH | 4*GGG GS bispecific CAR linker | anti CD19-VL | 3*GGG GS linker | anti CD19-VH |
| Example 4 | Tumor associated MUC1 scFv-1 or 2 VH | 3*GGG GS linker | Tumor associated MUC1 scFv-1 or 2 VL | 4*GGG GS bispecific CAR linker | anti CD19-VH | 3*GGG GS linker | anti CD19-VL |
| Example 5 | humanized anti CD19-VH | 3*GGG GS linker | humanized anti CD19-VL | 4*GGG GS bispecific CAR linker | Tumor associated MUC1 scFv-1 or 2 VL | 3*GGG GS linker | Tumor associated MUC1 scFv-1 or 2 VH |

3*(GGGGS) is (GGGGS)$_3$ and 4*(GGGGS) is (GGGGS)$_4$.

In embodiments, the two different antigen binding domains can be on a CAR and a T cell receptor (TCR) and are encoded by separate nucleic acids. The binding domain of a TCR can target a specific tumor antigen or tumor marker on the cell of a tumor. In embodiments the TCR binding domain is a TCR alpha binding domain or TCR beta binding domain that targets a specific tumor antigen. In embodiments, the TCR comprises the TCRγ and TCRσ chains or the TCRα and TCRβ chains.

The present disclosure also describes vectors including the nucleic acids described above. In embodiments, a single ments, the modified cells include T cells containing a TCR including the second antigen binding domain.

Further, the present disclosure describes compositions including a mixed population of the modified cells described herein. In embodiments, the modified cells include modified lymphocytes. In embodiments, the modified lymphocytes are modified T cells, modified NK cell, or modified dendritic cells. In embodiments, the modified T cells are CAR T cells.

The present disclosure describes a mixed population of modified cells effective for expanding and/or maintaining the modified cells in a patient. In embodiments, examples of a mixed population of modified cells include the following: (1) a first modified cell expressing an antigen binding domain for expanding and/or maintaining the modified cells and a second modified cell expressing an antigen binding domain for killing a target cell, such as a tumor cell; (2) the modified cells of (1) and a further modified cell expressing at least two different antigen binding domains, a first antigen binding domain for expanding and/or maintaining the modified cells and a second antigen binding domain for killing a target cell (wherein the two different antigen binding domains are expressed on the same cell); (3) a modified cell expressing at least two different antigen binding domains, a first antigen binding domain for expanding and/or maintaining the modified cells and a second antigen binding domain for killing a target cell (wherein the two different antigen binding domains are expressed on the same cell); (4) a modified cell expressing an antigen binding domain for killing a target cell and a modified cell expressing at least two antigen binding domains, a first antigen binding domain for expanding and/or maintaining the modified cells and a second antigen binding domain for killing a target cell (wherein the two different antigen binding domains are expressed on the same modified cell); or (5) a modified cell expressing an antigen binding domain for expanding and/or maintaining the modified cells and a modified cell expressing at least two antigen binding domains, a first antigen binding domain for expanding and/or maintaining the modified cells and a second antigen binding domain for killing a target cell (wherein the two different antigen binding domains are expressed on the same modified cell). In embodiments, the two antigen binding domains are different molecules. In embodiments, the antigen binding domain for expanding the modified cells (the first antigen binding domain) is an antigen binding domain that binds a WBC, such as a B cell, and the antigen binding domain for killing a target cell, such as tumor cell, (the second antigen binding domain) is an antigen binding domain that binds a tumor. In embodiments, the antigen binding domain binding a B cell binds the surface antigen of the B cell, for example, CD19, and the antigen binding domain binding a tumor binds an antigen of a tumor, for example tMUC1. In embodiments, the tumor cell is a solid tumor cell.

The mixed population of modified cells described herein includes about 1% to 10% modified cells expressing the first antigen binding domain, 50% to 60% modified cells expressing a second antigen binding domain, and about 10% modified cells expressing both the first antigen binding domain and the second antigen binding domain (wherein the first and second antigen binding domains are expressed in a single cell).

The present disclosure also describes methods of culturing cells described above. The methods described herein include obtaining a cell comprising a first antigen binding domain and/or a second antigen binding domain, wherein the first antigen binding domain binds a cell surface molecule of a WBC, and the second antigen binding domain binds an antigen different from the cell surface molecule of the WBC; and culturing the cell in the presence of an agent derived from a cell surface molecule of the WBC or from an antigen to which the second antigen binding domain binds. In embodiments, the agent is an extracellular domain of a cell surface molecule of a WBC.

The present disclosure also describes methods of culturing mixed population of cells described above. The methods described herein include obtaining a mixed population of cells comprising a first antigen binding domain and/or a second antigen binding domain, wherein the first antigen binding domain binds a cell surface molecule of a WBC, and the second antigen binding domain binds an antigen different from the cell surface molecule of the WBC; and culturing the cells in the presence of an agent derived from a cell surface molecule of the WBC or from an antigen to which the second antigen binding domain binds. In embodiments, the agent is an extracellular domain of a cell surface molecule of a WBC.

The present disclose describes methods for in vitro cell preparation, wherein the method includes providing cells; introducing one or more nucleic acids described herein encoding a first antigen binding domain and/or a second antigen binding domain into the cells, wherein the first antigen binding domain binds a cell surface molecule of a WBC, and the second antigen binding domain binds an antigen different from the cell surface molecule of the WBC; and culturing the cells in the presence of an agent derived from the cell surface molecule of the WBC or from an antigen to which the second antigen binding domain binds. The methods provide genetically modified cells including a first antigen binding domain, cells including a second binding domain, and cells including both the first and second antigen binding domain. The methods provide cells with single binding domains and cells expressing both antigen binding domains. The methods also provide a mixed population of cells including cells including a single binding domain and cells expressing both antigen binding domains. Additionally, the methods provide compositions including a mixed population of cells described herein.

The present disclosure describes using the prepared cell preparation, the mixed population of cells, or the compositions of mixed population of cells to enhance and maintain the T cell expansion in a subject having cancer, in order to be effective in killing the tumorigenic cells in the subject. In embodiments, the method comprises introducing a plurality of nucleic acids described herein into T cells to obtain a mixed population of modified T cells, the plurality of nucleic acids encoding a chimeric antigen receptor (CAR) or TCR binding a solid tumor antigen and/or encoding a CAR binding an antigen of a WBC; and administering an effective amount of a mixed population of modified cells to the subject, wherein examples of a mixed population of modified cells include the following: (1) T cells containing a CAR or TCR binding a solid tumor antigen and T cells containing a CAR binding an antigen of a WBC; (2) the T cells of (1) and further T cells containing both (i) a CAR or TCR binding a solid tumor antigen, and (ii) a CAR binding an antigen of a WBC (both (i) and (ii) are in a single modified T cell); (3) T cells containing both (i) the CAR or TCR binding a solid tumor antigen, and (ii) a CAR binding an antigen of a WBC (both (i) and (ii) are in a single modified T cell); (4) T cells containing a CAR or TCR binding a solid tumor antigen and T cells containing both (i) a CAR or TCR binding a solid tumor antigen and (ii) a CAR binding an antigen of a WBC (both (i) and (ii) are in a single modified T cell); or (5) T cells containing a CAR binding an antigen of a WBC and T cells containing both (i) a CAR or TCR binding a solid tumor antigen and (ii) a CAR binding an antigen of a WBC (both (i) and (ii) are in a single modified T cell). In embodiments, the WBC is a B cell. Additionally, the present disclosure describes methods for introducing and/or enhancing lymphocyte (T cell) response in a subject wherein the response is to a therapeutic agent or a therapy for treating the subject. Embodiments described herein involve a mechanism that expands and/or maintains the lymphocytes and a mechanism that relates to binding of a CAR to a tumor cell. In embodiments, the first mechanism involves a molecule involved in expanding and/or maintaining the lymphocytes in a subject, and an additional mechanism involves a molecule directed to inhibiting the growth of, or the killing of a tumor cell in the subject. In embodiments, the mechanisms involve signal transduction and molecules or domains of a molecules responsible for signal transduction are involved in the mechanisms described herein. For example, the first mechanism includes a CAR binding an antigen associated with blood, such as blood cells and blood plasma, or non-essential tissues, and the additional mechanism includes a CAR or TCR targeting an antigen associated with the tumor cell. Examples of non-essential tissues include the mammary gland, colon, gastric gland, ovary, blood components (such as WBC), and thyroid. In embodiments, the first mechanism involves a first antigen binding domain of a molecule, and the additional mechanism involves a second antigen binding domain of a molecule. In embodiments, the first mechanism and the additional mechanism are performed by a mixed population of modified cells. In embodiments, the mechanism involves a cell expressing an antigen associated with a tumor cell, and the additional mechanism involves a lymphocyte, such as a B cell, expressing a cell surface antigen.

The methods described herein involves lymphocytes expressing an expansion molecule and a function molecule. In embodiments, the expansion molecule expands and/or maintains the lymphocytes in a subject, and the function molecule inhibits the growth of or kills a tumor cell in the subject. In embodiments, the expansion molecule and the function molecule are on a single CAR molecule, for example a bispecific CAR molecule. In embodiments, the expansion molecule and the function molecule are on separate molecules, for example, CAR and TCR or two different CARs. The expansion molecule can include a CAR binding to an antigen associated with blood (e.g., blood cells and blood plasma) or non-essential tissues, and the function molecule can include a CAR or TCR targeting an antigen associated with a tumor cell.

Lymphocyte or T cell response in a subject refers to cell-mediated immunity associated with a helper, killer, regulatory, and other types of T cells. For example, T cell response may include activities such as assisting other WBCs in immunologic processes and identifying and destroying virus-infected cells and tumor cells. T cell response in the subject can be measured via various indicators such as a number of virus-infected cells and/or tumor cells that T cells kill, the amount of cytokines (e.g., IL-6 and IFN-γ) that T cells release in vivo and/or in co-culturing with virus-infected cells and/or tumor cells, indicates a level of proliferation of T cells in the subject, a phenotype change of T cells, for example, changes to memory T cells, and a level longevity or lifetime of T cells in the subject.

In embodiments, the method of enhancing T cell response described herein can effectively treat a subject in need thereof, for example, a subject diagnosed with a tumor. The term tumor refers to a mass, which can be a collection of fluid, such as blood, or a solid mass. A tumor can be malignant (cancerous) or benign. Examples of blood cancers include chronic lymphocytic leukemia, acute myeloid leukemia, acute lymphoblastic leukemia, and multiple myeloma.

Solid tumors usually do not contain cysts or liquid areas. The major types of malignant solid tumors include sarcomas and carcinomas. Sarcomas are tumors that develop in soft tissue cells called mesenchymal cells, which can be found in blood vessels, bone, fat tissues, ligament lymph vessels, nerves, cartilage, muscle, ligaments, or tendon, while carcinomas are tumors that form in epithelial cells, which are found in the skin and mucous membranes. The most common types of sarcomas include undifferentiated pleomorphic sarcoma which involves soft tissue and bone cells; leiomyosarcoma which involves smooth muscle cells that line blood vessels, gastrointestinal tract, and uterus; osteosarcoma which involves bone cells, and liposarcoma which involves fat cells. Some examples of sarcomas include Ewing sarcoma, Rhabdomyosarcoma, chondosarcoma, mesothelioma, fibrosarcoma, fibrosarcoma, and glioma.

The five most common carcinomas include adrenocarcinoma which involves organs that produce fluids or mucous, such as the breasts and prostate; basal cell carcinoma which involves cells of the outer-most layer of the skin, for example, skin cancer; squamous cell carcinoma which involves the basal cells of the skin; and transitional cell carcinoma which affects transitional cells in the urinary tract which includes the bladder, kidneys, and ureter. Examples of carcinomas include cancers of the thyroid, breast, prostate, lung, intestine, skin, pancreas, liver, kidneys, and bladder, and cholangiocarcinoma.

The methods described herein can be used to treat a subject diagnosed with cancer. The cancer can be a blood cancer or can be a solid tumor, such as a sarcoma or carcinoma. The method of treating includes administering an effective amount of a mixed population of T cells described herein comprising a first antigen binding domain and/or a second antigen binding domain to the subject to provide a T-cell response, wherein the first antigen binding domain binds a cell surface molecule of a WBC, and the second antigen binding domain binds an antigen different from the cell surface molecule of the WBC. In embodiments, enhancing the T cell response in the subject includes selectively enhancing proliferation of T cell expressing the first antigen binding domain and the second antigen binding domain in vivo.

The methods for enhancing T cell response in a subject include administering to the subject T cells comprising a CAR or a bispecific CAR including two different antigen binding domains and T cells comprising a first CAR and a second CAR, wherein the first CAR and the second CAR, each includes a different antigen binding domain.

In embodiments, methods for enhancing T cell response in a subject described herein include administering to the subject T cells including a CAR molecule and a TCR molecule. The CAR molecule targets or binds a surface marker of a white blood cell, and the TCR molecule binds a marker or an antigen of the tumor that is expressed on the surface or inside the tumor cell.

In embodiments, the methods for enhancing T cell response in a subject in need thereof include administering to the subject, a mixed population of modified cells or a composition comprising a mixed population of modified cells. Examples of a mixed population of modified T cells include the following: (1) T cells containing a CAR binding an antigen of a WBC and T cells containing a CAR or TCR binding a tumor antigen; (2) the T cells of (1) and further T cells containing both (i) the CAR or TCR binding a tumor antigen, and (ii) a CAR binding an antigen of a WBC (both (i) and (ii) are in a single modified T cell); (3) T cells containing both (i) a CAR or TCR binding a tumor antigen, and (ii) a CAR binding an antigen of a WBC (both (i) and (ii) are in a single modified T cell); (4) T cells containing a CAR or TCR binding a tumor antigen and T cells containing both (i) a CAR or TCR binding a solid tumor antigen and (ii) a CAR binding an antigen of a WBC; or (5) T cells containing a CAR binding an antigen of a WBC and T cells containing both (i) a CAR or TCR binding a solid tumor antigen and (ii) the CAR binding the antigen of a WBC (both (i) and (ii) are in a single modified T cell). In embodiments, the subject is diagnosed with a solid tumor. In embodiments, the tumor antigen is a solid tumor antigen, for example tMUC1. In embodiments, the WBC is a B cell, and the antigen is a B cell antigen. In embodiments, the B cell antigen is CD19. In embodiments, the tumor antigen is tMUC1 and the antigen of a WBC is CD19.

The present disclosure describes methods of expanding and/or maintaining cells expressing an antigen binding domain in vivo. The method includes administering an effective amount of a mixed population of modified cells or a composition including a mixed population of modified cells described herein to a subject These methods described herein are useful for expanding T cells, NK cells, macrophages and/or dendritic cells.

The mixed population of modified T cells described herein include a first CAR and/or a second CAR or TCR. In embodiments, the first CAR contains a first antigen binding domain and the second CAR or TCR contains a second antigen binding domain. For example, the first CAR and the second CAR or TCR include an extracellular antigen binding domain, a transmembrane domain, and a cytoplasmic domain. The cytoplasmic domain of the first CAR and second CAR include a co-stimulatory domain and a CD3 zeta domain for transmitting signals for activation of cellular responses. In embodiments, the first CAR and second CAR or TCR are expressed on different modified T cells. In embodiments, the first CAR and second CAR or TCR are expressed on the same modified T cell.

In embodiments, in the mixed population of modified T cells described herein, the cytoplasmic domain of the first CAR, which contains an antigen binding domain for expanding and/or maintaining modified T cells, includes one or more co-stimulatory domains in the absence of a CD3 zeta domain such that activation or stimulation of the first CAR expands WBCs, such as lymphocytes, without introducing and/or activating the killing function of the modified T cells targeting the WBCs. In embodiments, the lymphocytes are T cells. In embodiments, when the cytoplasmic domain of the first CAR includes one or more co-stimulatory domains in the absence of a CD3 zeta domain, the second CAR includes a CD3 zeta domain.

In embodiments, the first and second antigen binding domains are on the same CAR (the first CAR), for example, a bispecific CAR with an extracellular antigen binding domain, a transmembrane domain, and a cytoplasmic domain. The extracellular antigen binding domain includes at least two scFvs and at least one of the scFvs function as a first antigen binding domain for binding a cell surface molecule of a WBC. In embodiments, the bispecific CAR is expressed on a modified T cell.

In embodiments, the antigen different from the cell surface molecule of the WBC is CD19, CD22, CD20, BCMA, CD5, CD7, CD2, CD16, CD56, CD30, CD14, CD68, CD11b, CD18, CD169, CD1c, CD33, CD38, CD138, CD13, B7-H3, CAIX, CD123, CD133, CD171, CD171/L1-CAM, CEA, Claudin 18.2, cMet, CS1, CSPG4, Dectin1, EGFR, EGFR vIII, EphA2, ERBB receptors, ErbB T4, ERBB2, FAP, Folate receptor 1, FITC, Folate receptor 1, FSH, GD2, GPC3, HA-1 H/HLA-A2, HER2, IL-11Ra, IL13 receptor a2, IL13R, IL13Ra2 (zetakine), Kappa, Leukemia, LewisY, Mesothelin, MUC1, NKG2D, NY-ESO-1, PSMA, ROR-1, TRAIL-receptor1, or VEGFR2.

In embodiments, the MUC1 is a tumor-exclusive epitope of a human MUC1, and the first CAR and the second CAR or the TCR are expressed as separate polypeptides. In embodiments, the MUC1 is a tumor form of human MUC1 (tMUC1).

In embodiments, in the mixed population of modified cells described herein, the first CAR, which includes an antigen binding domain for expanding and/or maintaining modified cells, may include a co-stimulatory domain without a signaling domain of CD3 zeta domain, and the CAR (second CAR) may comprise the MUC1 binding domain, a transmembrane domain, a co-stimulatory, and a CD3 zeta domain.

As used herein, the term "MUC1" refers to a molecule defined as follows. MUC1 is one of the epithelial mucin family of molecules. MUC1 is a transmembrane mucin glycoprotein that is normally expressed on all glandular epithelial cells of the major organs. In normal cells, MUC1 is only expressed on the apical surface and is heavily glycosylated with its core proteins sequestered by the carbohydrates. As cells transform to a malignant phenotype, expression of MUC1 increases several folds, and the expression is no longer restricted to the apical surface, but it is found all around the cell surface and in the cytoplasm. In addition, the glycosylation of tumor associated MUC1 (tMUC1) is aberrant, with greater exposure of the peptide core than is found on MUC1 expressed in normal tissues.

MUC1 is widely expressed on a large number of epithelial cancers and is aberrantly glycosylated making it structurally and antigenically distinct from that expressed by non-malignant cells (see, e.g., Barratt-Boyes, 1996; Price et al., 1998; Peterson et al., 1991). The dominant form of MUC1 is a high molecular weight molecule comprising a large highly immunogenic extracellular mucin-like domain with a large number of twenty amino acid tandem repeats, a transmembrane region, and a cytoplasmic tail (Quin et al., 2000; McGucken et al., 1995; Dong et al., 1997).

In most epithelial adenocarcinomas including breast and pancreas, MUC1 is overexpressed and aberrantly glycosylated. Adenocarcinoma of the breast and pancreas not only overexpress MUC1 but also shed MUC1 into the circulation. High MUC1 serum levels are associated with progressive disease. MUC1 has been exploited as a prospective biomarker because of the complex and heterogeneous nature of the epitopes expressed within the antigen. MUC1 synthesized by cancerous tissues (e.g., tumor associated MUC1) usually displays an aberrant oligosaccharide profile, which gives rise to the expression of neomarkers such as sialyl-Lea (assayed in the CA19-9 test), sialyl-Lex, and sialyl-Tn (TAG-72), as well as the cryptic epitopes such as Tn.

Several antibodies are being developed against MUC1 for therapeutic use. Pemtumomab (also known as HMFG1) is in Phase III clinical trials as a carrier to deliver the radioisotope Yttrium-90 into tumors in ovarian cancer (reviewed in Scott et al., 2012). CA15-3 (also the HMFG1 antibody), CA27-29, and CA19-9 are all antibodies to MUC1 that are used to assess levels of circulating MUC1 in patients with cancer. However, these antibodies have shown limited utility as therapeutic agents or as biomarkers because they cannot distinguish effectively between MUC1 expressed on normal versus transformed tumor epithelia. In other words, none of these antibodies appear to be targeted to a tumor associated MUC1 (tMUC1) epitope.

A new antibody that is highly specific for a tumor associated form of MUC1 (tMUC1) is designated TAB-004 and is described in U.S. Pat. No. 8,518,405 (see also Curry et al., 2013). While Pemtumomab (HMFG1) was developed using human milk fat globules as the antigen (Parham et al., 1988), TAB-004 was developed using tumors expressing an altered form of MUC1 (Tinder et al., 2008). TAB-004 recognizes the altered glycosylated epitope within the MUC1 tandem repeat sequence. This area is accessible for antigenic detection in tMUC but is blocked from antigenic detection in normal MUC1 by large branches of glycosylation (Gendler, 2001; Mukherjee et al., 2003b; Hollingsworth & Swanson, 2004; Kufe, 2009). Importantly, TAB-004 is different from the epitopes recognized by other MUC1 antibody and has unique complementary determinant regions (CDRs) of the heavy and light chains. The antibody binds the target antigen with a high binding affinity at 3 ng/ml (20 pM) and does not bind unrelated antigens (Curry et al., 2013). Thus, TAB-004 distinguishes between normal and tumor form of MUC1 while HMFG1 (Pemtumomab) does not (see U.S. Pat. No. 8,518,405).

In embodiments, the first CAR comprises the first antigen binding domain, a transmembrane domain, a co-stimulatory domain, and a CD3 zeta domain, and/or the second CAR comprises the second antigen binding domain, a transmembrane domain, a co-stimulatory domain, and a CD3 zeta domain.

In embodiments, the antigen binding domain is a Fab or a scFv. In embodiments, the first CAR comprises the amino acid sequence of one of SEQ ID NO: 5, 6, and 53-58; and the second CAR comprises the amino acid sequence of one of SEQ ID NOs: 5-17, 29, 33, 37, 71, and 72, or the amino acid sequence encoded by the nucleic acid sequence of one of SEQ ID Nos: 41, 45, 63, 67, and 68. In embodiments, a nucleic acid sequence encoding the first CAR comprises the nucleic acid sequence of SEQ ID NO: 59 or 60, and a nucleic acid sequence encoding the second CAR comprises the nucleic acid sequence of SEQ ID NO: 61. In embodiments, the nucleic acid comprises one of the nucleic acid sequence of SEQ ID NO: 62-69. In embodiments, the first CAR and the second CAR are expressed as separate polypeptides.

In embodiments, the first antigen binding domain is on a CAR and the second antigen binding domain is on a T Cell Receptor (TCR). In embodiments, the TCR is a modified TCR. In embodiments, the TCR is derived from spontaneously occurring tumor-specific T cells in patients. In embodiments, the TCR binds a tumor antigen. In embodiments, the tumor antigen comprises CEA, gp100, tMUC1, MART-1, p53, MAGE-A3, or NY-ESO-1.

In embodiments, a T cell clone that expresses a TCR with high affinity for the target antigen may be isolated. Tumor-infiltrating lymphocytes (TILs) or peripheral blood mononuclear cells (PBMCs) can be cultured in the presence of antigen-presenting cells (APCs) pulsed with a peptide representing an epitope known to elicit a dominant T cell response when presented in the context of a defined HLA allele. High-affinity clones may then be selected on the basis of MHC-peptide tetramer staining and/or the ability to recognize and lyse target cells pulsed with low titrated concentrations of cognate peptide antigen. After the clone has been selected, the TCRα and TCRβ chains or TCRγ and TCRσ chains are identified and isolated by molecular cloning. For example, for TCRα and TCRβ chains, the TCRα and TCRβ gene sequences are then used to generate an expression construct that ideally promotes stable, high-level expression of both TCR chains in human T cells. The transduction vehicle, for example, a gammaretrovirus or lentivirus, can then be generated and tested for functionality (antigen specificity and functional avidity) and used to produce a clinical lot of the vector. An aliquot of the final product can then be used to transduce the target T cell population (generally purified from patient PBMCs), which is expanded before infusion into the patient.

Various methods may be implemented to obtain genes encoding tumor-reactive TCR. More information is provided in Kershaw et al., Clin Transl Immunology. 2014 May; 3 (5): e16. In embodiments, specific TCR can be derived from spontaneously occurring tumor-specific T cells in patients. Antigens included in this category include the melanocyte differentiation antigens MART-1 and gp100, as well as the MAGE antigens and NY-ESO-1, with expression in a broader range of cancers. TCRs specific for viral-associated malignancies can also be isolated, as long as viral proteins are expressed by transformed cells. Malignancies in this category include liver and cervical cancer, associated with hepatitis and papilloma viruses, and Epstein-Barr virus-associated malignancies. In embodiments, target antigens of the TCR may include CEA (e.g., for colorectal cancer), gp100, MART-1, p53 (e.g., for Melanoma), MAGE-A3 (e.g., Melanoma, esophageal and synovial sarcoma), NY-ESO-1 (e.g., for Melanoma and sarcoma as well as Multiple myelomas).

In embodiments, a binding domain of the first CAR binds CD19, and a binding domain of the second CAR binds tumor associated MUC1 (tMUC1). In embodiments, the binding domain of the second CAR comprises: (i) a heavy chain complementary determining region 1 comprising the amino acid sequence of SEQ ID: 76 or 85, a heavy chain complementary determining region 2 comprising the amino acid sequence of SEQ ID: 77 or 86, and a heavy chain complementary determining region 3 comprising the amino acid sequence of SEQ ID: 78 or 87; and (ii) a light chain complementary determining region 1 comprising the amino acid sequence of SEQ ID: 73 or 82, a light chain complementary determining region 2 comprising the amino acid sequence of TRP-ALA-SER (WAS) or SEQ ID: 83, and a light chain complementary determining region 3 comprising the amino acid sequence of SEQ ID: 75 or 84.

In embodiments, the binding domain of the second CAR comprises: (i) a heavy chain complementary determining region 1 comprising the amino acid sequence of SEQ ID: 76, a heavy chain complementary determining region 2 comprising the amino acid sequence of SEQ ID: 77, and a heavy chain complementary determining region 3 comprising the amino acid sequence of SEQ ID: 78; and (ii) a light chain complementary determining region 1 comprising the amino acid sequence of SEQ ID: 73, a light chain complementary determining region 2 comprising the amino acid sequence of TRP-ALA-SER (WAS), and a light chain complementary determining region 3 comprising the amino acid sequence of SEQ ID: 75.

In embodiments, the binding domain of the second CAR comprises: (i) a heavy chain complementary determining region 1 comprising the amino acid sequence of SEQ ID: 85, a heavy chain complementary determining region 2 comprising the amino acid sequence of SEQ ID: 86, and a heavy chain complementary determining region 3 comprising the amino acid sequence of SEQ ID: 87; and (ii) a light chain complementary determining region 1 comprising the amino acid sequence of SEQ ID: 82, a light chain complementary determining region 2 comprising the amino acid sequence of SEQ ID: 83, and a light chain complementary determining region 3 comprising the amino acid sequence of SEQ ID: 84. In embodiments, the binding domain of the first CAR comprises the amino acid sequence of SEQ ID: 5 or 6. In embodiments, the binding domain of the second CAR comprises one of the amino acid sequences of SEQ ID: 70-72 and 79-81.

In embodiments, the first CAR comprises the first antigen binding domain, a transmembrane domain, a co-stimulatory domain, and a CD3 zeta domain and/or the second CAR comprises the second antigen binding domain, a transmembrane domain, a co-stimulatory domain, and a CD3 zeta domain.

In embodiments, the first CAR and the second CAR are expressed as separate polypeptides.

In embodiments, the cytoplasmic domain or the transmembrane domain of the second CAR is modified such that the second CAR is capable of activating the modified T cell via cells expressing CD19 without damaging the cells expressing CD19.

Embodiments described herein relate to a bispecific chimeric antigen receptor, comprising: a first antigen binding domain, a second antigen binding domain, a cytoplasmic domain, and transmembrane domain, wherein the first antigen binding domain recognizes a first antigen, and the second antigen binding domain recognizes a second antigen, the first antigen is different from the second antigen.

In embodiments, the first antigen and the second antigen do not express on the same cell. In embodiments, the first antigen is an antigen of a blood component, and the second antigen is an antigen of a solid tumor.

Blood cells refer to red blood cells (RBCs), white blood cells (WBCs), platelets, or other blood cells. For example, RBCs are blood cells of delivering oxygen ($O_2$) to the body tissues via the blood flow through the circulatory system. Platelets are cells that are involved in hemostasis, leading to the formation of blood clots. WBCs are cells of the immune system involved in defending the body against both infectious disease and foreign materials. There are a number of different types and sub-types of WBCs and each has a different role to play. For example, granulocytes, monocytes, and lymphocytes are 3 major types of white blood cell. There are three different forms of granulocytes: Neutrophils, Eosinophils, Basophils.

A cell surface molecule of a WBC refers to a molecule expressed on the surface of the WBC. For example, the cell surface molecule of a lymphocyte may include CD19, CD22, CD20, BCMA, CD5, CD7, CD2, CD16, CD56, and CD30. The cell surface molecule of a B cell may include CD19, CD20, CD22, BCMA. The cell surface molecule of a monocyte may include CD14, CD68, CD11b, CD18, CD169, and CD1c. The cell surface molecule of granulocyte may include CD33, CD38, CD138, and CD13.

In embodiments, the first antigen is CD19, and the second antigen is a tumor associated MUC1 (tMUC1). In embodiments, the first antigen binding domain comprises one of the amino acid sequences of SEQ ID: 5 and 6. In embodiments, the second antigen binding domain comprises one of the amino acid sequence of SEQ ID: 70-72 and 79-81.

In embodiments, the present disclosure describes a method of enhancing T cell response in a subject or treating a tumor of the subject, the method comprising: administering an effective amount of a mixed population of modified T cells or a composition of a mixed population of modified T cells, described herein, to the subject to provide a T cell response such that the CAR T cell is expanded in the blood of the subject via cells expressing CD19. In embodiments, the method may further comprise infusing B cells into the subject to continue to activate and/or expand the CAR T cells. For example, the B cells of the subject or genetically modified B cells from healthy donor may be obtained and stored before CAR T cell infusion. In embodiments, the method may further comprise administering a cell expressing CD19 or a polypeptide comprising at least an extracellular domain of CD19 or the antigen that the CAR T cells recognize. For example, the cell expressing CD19 may include cell lines such as K562 and NK92 that are transduced with nucleic acid sequences encoding CD19. In embodiments, the method may further comprise identifying CAR T cells expressing both first and second CAR, as well as administering the identifier CAR T cells to the subject. For example, MUC1 may be associated as a sorting marker such that CAR T cells expressing MUC1 may be identified timely.

In embodiments, the tumor associated MUC1 (tMUC1) is expressed on tumor cells, but not on corresponding non-malignant cells. In embodiments, a scFv against the tumor associated MUC1 directly interacts with an o-glycosylated GSTA motif (SEQ ID NO. 88).

In embodiments, the present disclosure describes a method of in vivo cell expansion and maintenance. In embodiments, the method may include administering an effective amount of a mixed population of modified T cells described herein to the subject in need thereof to provide a T cell response; and administering an effective amount of presenting cells (e.g., T cells) expressing a soluble agent that an extracellular domain of the CAR recognizes. In embodiments, the method may be implemented to enhance T cell response in a subject in need thereof. The method may include administering an effective amount of a mixed population of modified T cells comprising a CAR to the subject to provide a T cell response and administering an effective amount of presenting cells expressing a soluble agent that an extracellular domain of the CAR recognizes to enhance the T cell response in the subject. In certain embodiments, the presenting cells are T cells, dendritic cells, and/or antigen presenting cells. In certain embodiments, the enhancing T cell response in the subject may include selectively enhancing proliferation of T cell comprising the CAR. In embodiments, the method may be used to enhance treatment of a condition of a subject using modified T cells. The method may include administering a population of cells that express an agent or administering an agent that is formulated as a vaccine. In these instances, the modified T cells include a nucleic acid that encodes a CAR, and an extracellular domain of the CAR recognize the agent. In embodiments, the method may be implemented to enhance proliferation of the modified T cells in a subject having a disease. The method may include preparing the modified T cells comprising a CAR; administering an effective amount of the modified T cells to the subject; introducing, into cells, a nucleic acid encoding an agent that an extracellular domain of the CAR recognizes; and administering an effective amount of the cells (introduced with the nucleic acid encoding the agent) to the subject. In embodiments, the T cell expansion may be measured based on an increase in copy number of CAR molecules in genomic DNA of the T cells. In embodiments, the T cell expansion may be measured based on flow cytometry analysis on molecules expressed on the T cells.

Embodiments described herein relate to mixed population of modified T cells comprising a first CAR and a second CAR or TCR in separate T cells and/or in the same T cells, wherein an antigen binding domain of the first CAR binds an antigen such as CD19, CD33, CD14, and BCMA, and an antigen binding domain of the second CAR binds a tumor associated MUC. In embodiments, the tumor associated MUC is MUC1 (for example tMUC1) or MUC2. Embodiments described herein relate to a composition comprising a mixed population of the modified T cells and to a method of enhancing T cell response in a subject or treating a tumor of the subject, the method comprising: administering an effective amount of the mixed population of modified T cells.

In embodiments, the first CAR comprises the amino acid sequence of SEQ ID NO: 207, and the second CAR comprises the amino acid sequence of SEQ ID: 202. In embodiments, the first CAR comprises the amino acid sequence of SEQ ID NO: 203, 207, 216, or 219, and the second CAR comprises the amino acid sequence of SEQ ID: 202 or 205. In embodiments, the antigen binding domain of the second CAR comprises the amino acid sequence of SEQ ID NO: 70. In embodiments, the antigen binding domain of the second CAR comprises the amino acid sequence of SEQ ID NO: 5 or 6. In embodiments, the a modified T cell described herein comprises a nucleic acid sequences of SEQ ID NO: 201, 204, 206, 208, 215, 217, 218, or 220. In embodiments, each of the first CAR and the second CAR comprises an antigen binding domain, a transmembrane domain, and a cytoplasmic domain.

In embodiments, the cytoplasmic domain of the CAR molecules described herein comprise a co-stimulatory domain and a CD3 zeta domain. In embodiments, the CAR molecules described herein may include a co-stimulatory domain without a corresponding component of CD3 zeta domain. In embodiments, the CAR molecules described herein may include a CD3 zeta domain without a co-stimulatory domain.

In embodiments, the modified cell comprises a dominant negative variant of a receptor of programmed death 1 (PD-1), cytotoxic T lymphocyte antigen-4 (CTLA-4), B- and T-lymphocyte attenuator (BTLA), T cell immunoglobulin mucin-3 (TIM-3), lymphocyte-activation protein 3 (LAG-3), T cell immunoreceptor with Ig and ITIM domains (TIGIT), leukocyte-associated immunoglobulin-like receptor 1 (LAIRI), natural killer cell receptor 2B4 (2B4), or CD 160. In embodiments, the modified cell further comprises a nucleic acid sequence encoding a suicide gene, and/or the suicide gene comprises a HSV-TK suicide gene system. In embodiments, the isolated T cell comprises a reduced amount of TCR, as compared to the corresponding wide-type T cell.

Dominant negative mutations have an altered gene product that acts antagonistically to the wild-type allele. These mutations usually result in an altered molecular function (often inactive) and are characterized by a dominant or semi-dominant phenotype. In embodiments, the modified cells described herein comprise the dominant negative (DN) form of the PD-1 receptor. In embodiments, the expression of the DN PD-1 receptor in the modified cells described herein is regulated by an inducible gene expression system. In embodiments, the inducible gene expression system is a lac system, a tetracycline system, or a galactose system.

The present disclosure describes pharmaceutical compositions. The pharmaceutical compositions include one or more of the following CAR molecules, TCR molecules, modified CAR T cells, modified cells comprising CAR or TCR, mix population of modified cells, nucleic acids, and vectors described above. Pharmaceutical compositions are administered in a manner appropriate to the disease to be treated (or prevented). The quantity and frequency of administration will be determined by such factors as the condition of the patient, and the type and severity of the patient's disease, although appropriate dosages may be determined by clinical trials.

When "an immunologically effective amount", "an anti-tumor effective amount", "a tumor-inhibiting effective amount", or "a therapeutically effective amount" is indicated, the precise amount of the compositions of the present disclosure to be administered can be determined by a physician with consideration of individual differences in age, weight, tumor size, extent of infection or metastasis, and condition of the patient (subject). It can be stated that a pharmaceutical composition comprising the modified cells described herein may be administered at a dosage of $10^4$ to $10^9$ cells/kg body weight, preferably $10^5$ to $10^6$ cells/kg body weight, including all integer values within those ranges. Modified cell compositions may also be administered multiple times at these dosages. The cells can be administered by using infusion techniques that are commonly known in immunotherapy (see, e.g., Rosenberg et al., New Eng. J. of Med. 319:1676, 1988). The optimal dosage and treatment regime for a particular patient can readily be determined by one skilled in the art of medicine by monitoring the patient for signs of disease and adjusting the treatment accordingly. In certain embodiments, it may be desired to administer activated T cells to a subject and then subsequently redraw the blood (or have apheresis performed), collect the activated and expanded T cells, and reinfuse the patient with these activated and expanded T cells. This process can be carried out multiple times every few weeks. In certain embodiments, T cells can be activated from blood draws of from 10 cc to 400 cc. In certain embodiments, T cells are activated from blood draws of 20 cc, 30 cc, 40 cc, 50 cc, 60 cc, 70 cc, 80 cc, 90 cc, or 100 cc. Not to be bound by theory, using this multiple blood draw/multiple reinfusion protocols, may select out certain populations of T cells.

In embodiments, a mixed population of therapeutically effective amount of modified cells can be administered to the subject in need thereof sequentially or simultaneously. As an example, for a mixed population of two different modified cells, a therapeutically effective amount of the modified cells containing the antigen binding domain for expanding and/or maintaining the modified cells can be administered before, after, or at the same time a therapeutically effective amount of the modified cells containing the antigen binding domain for killing a target cell. As another example of a mixed population of two different modified cells, a therapeutically effective amount of the modified cells containing the antigen binding domain for killing a target cell can be administered before, after, or at the same time a therapeutically effective amount of the modified cells containing both the antigen binding domains of expanding and/or maintaining the modified cells and of killing a target cell (in a single modified cell). As an example, for a mixed population of three different modified cells including (1) modified cells containing an antigen binding domain for expanding and/or maintaining the modified cells, (2) modified cells containing an antigen binding domain for killing a target cell, and (3) modified cells containing both the antigen binding domains of expanding and/or maintaining the modified cells and of killing a target cell (in a single modified cell), a therapeutically effective amount of (1), (2), and (3) can be administered sequentially in any order (1,2,3; 2,3,1; 3,1,2; 1,3,2; 2,1,3; or 3,2,1) or simultaneously (1+2+3 at the same time). Moreover, two of the three modified cells can be combined and administered together with the third one being administered before or after the combination. For example, the combination of (1) and (2) can be administered before or after (3); or the combination of (1) and (3) can be administered before or after (2); or the combination of (2) and (3) can be administered before or after (1).

The administration of the pharmaceutical compositions described herein may be carried out in any convenient manner, including by aerosol inhalation, injection, ingestion, transfusion, implantation, or transplantation. The compositions described herein may be administered to a patient subcutaneously, intradermally, intratumorally, intranodally, intramedullary, intramuscularly, by intravenous (i. v.) injection, or intraperitoneally. In embodiments, the modified cell compositions described herein are administered to subjects by intradermal or subcutaneous injection. In embodiments, the T cell compositions of the present disclosure are administered by i.v. injection. The compositions of modified cells may be injected directly into a tumor, lymph node, or site of infection. In embodiments, cells activated and expanded using the methods described herein, or other methods known in the art where T cells are expanded to therapeutic levels, are administered to patients in conjunction with (e.g., before, simultaneously or following) any number of relevant treatment modalities, for example as a combination therapy, including but not limited to treatment with agents for antiviral therapy, cidofovir and interleukin-2, Cytarabine (also known as ARA-C); or natalizumab treatment for MS patients; or efalizumab treatment for psoriasis patients or other treatments for PML patients. In further embodiments, the T cells described herein can be used in combination with chemotherapy, radiation, immunosuppressive agents, such as cyclosporin, azathioprine, methotrexate, mycophenolate, and FK506, antibodies, or other immunoablative agents such as CAM PATH, anti-CD3 antibodies or other antibody therapies, cytoxin, fludaribine, cyclosporin, FK506, rapamycin, mycophenolic acid, steroids, FR901228, cytokines, and irradiation. These drugs inhibit either the calcium dependent phosphatase calcineurin (cyclosporine and FK506) or inhibit the p70S6 kinase that is important for growth factor induced signaling (rapamycin). (Liu et al., Cell 66:807-815, 1991; Henderson et al., Immun 73:316-321, 1991; Bierer et al., Curr. Opin. Immun 5:763-773, 1993; Isoniemi (supra)). In embodiments, the cell compositions described herein are administered to a subject in conjunction with (e.g., before, simultaneously or following) bone marrow transplantation, T cell ablative therapy using either chemotherapy agents such as, fludarabine, external-beam radiation therapy (XRT), cyclophosphamide, or antibodies such as OKT3 or CAM-PATH. In embodiments, the cell compositions described herein are administered following B-cell ablative therapy. For example, agents that react with CD20, e.g., Rituxan may be administered to patients. In embodiments, subjects may undergo standard treatment with high dose chemotherapy followed by peripheral blood stem cell transplantation. In certain embodiments, following the transplant, subjects receive an infusion of the expanded immune cells of the present disclosure. In embodiments, expanded cells are administered before or following surgery. The dosage of the above treatments to be administered to a subject in need thereof will vary with the precise nature of the condition being treated and the recipient of the treatment. The scaling of dosages for human administration can be performed according to art-accepted practices by a physician depending on various factors. Additional information on the methods of cancer treatment using modified cells is provided in U.S. Pat. No. U.S. Pat. No. 8,906,682, incorporated by reference in its entirety.

Embodiments described herein relate to an in vitro method for preparing modified cells. The method may include obtaining a sample of cells from a subject. For example, the sample may include T cells or T cell progenitors. The method may further include transfecting the sample of cells with a DNA encoding at least a CAR and culturing the sample of cells ex vivo in a medium that selectively enhances proliferation of CAR-expressing T cells. The sample of cells can be a mixed population of modified cells described herein.

In embodiments, the sample is a cryopreserved sample. In embodiments, the sample of cells is from umbilical cord blood or a peripheral blood sample from the subject. In embodiments, the sample of cells is obtained by apheresis or venipuncture. In embodiments, the sample of cells is a subpopulation of T cells.

In embodiments, the modified cell is a modified stem cell, a modified T cell, or a modified Natural Killer (NK) cell. In embodiments, the modified cell is a T cell derived from a primary human T cell isolated from a human donor. In embodiments, the cell has a reduced expression of an endogenous gene of CTLA4, LAG3, BTLA, TIM3, FOXP3, SIVA1, and LGALS9.

CTLA4 is an inhibitory receptor acting as a major negative regulator of T-cell responses. T lymphocyte receptor CTLA-4 binds costimulatory molecules CD80 (B7-1) andCD86 (B7-2) with higher avidity than stimulatory co-receptor CD28 and negatively regulates T cell activation. LAG3 is a member of the immunoglobulin superfamily and is expressed on the surface of activated T and NK cells. LAG3 has also been detected on the surface of B cells, dendritic cells, TILs and Tregs. Blockage of LAG3 significantly increases T cell proliferation and function. TIM3 is an immune checkpoint receptor constitutively expressed by CD4+T helper 1 (Th1), CD8+T cytotoxic 1 cells (Tc1) and Th17 cells. The interaction between TIM3 and its ligand galectin-9 LGALS9 is believed to result in suppression of T-cell responses. FOXP3 is a member of the forkhead/winged-helix family of transcriptional regulators, which is crucial for the development and inhibitory function of regulatory T-cells (Treg). SIVA1 induces CD27-mediated apoptosis, inhibits BCL2L1 isoform Bcl-x (L) anti-apoptotic activity, inhibits activation of NF-kappa-B, and promotes T-cell receptor-mediated apoptosis.

Embodiments relate to modified cells comprising isolated nucleic acid sequence encoding a chimeric antigen receptor (CAR), wherein an endogenous gene is inactivated using the ZFN.

In embodiments, the CAR comprises an antigen binding domain, a transmembrane domain, a co-stimulatory domain, and a CD3 zeta signaling domain.

In embodiments, the modified T cell has a reduced graft-versus-host disease (GVHD) response in a bioincompatible human recipient as compared to the GVHD response of the primary human T cell.

In embodiments, the antigen binding domain of the CAR binds FZD10, TSHR, PRLR, Muc17, GUCY2C, CD207, CD19, or CD20.

Ir In embodiments, the antigen binding domain of the CAR binds at least one of B7, BCMA, CAIX, CD123, CD133, CD138, CD171, CD171/L1-CAM, CD19, CD2, CD22, CD30, CD33, CEA, cMet, CS1, CSPG4, Dectin1, EGFR, EGFR vIII, EphA2, ERBB receptors, ErbB T4, ERBB2, FAP, Folate receptor 1, FITC, Folate receptor 1, GD2, GPC3, HA-1 H/HLA-A2, HER2, IL-11Ra, IL13 receptor a2, IL13R, IL13Ra2 (zetakine), Kappa, LewisY, Mesothelin, MUC1, NKG2D, NY-ESO-1, PSMA, ROR-1, TRAIL-receptor1, or VEGFR2.

In embodiments, the co-stimulatory domain of the CAR comprises the intracellular domain of a costimulatory molecule selected from the group consisting of CD27, CD28, 4-1BB, OX40, CD30, CD40, PD-1, ICOS, lymphocyte function-associated antigen-1 (LFA-1), CD2, CD7, LIGHT, NKG2C, B7-H3, and any combination thereof.

In embodiments, the modified cells include a nucleic acid sequence encoding hTERT or a nucleic acid encoding SV40LT, or a combination thereof. In embodiments, the modified cells include a nucleic acid sequence encoding hTERT and a nucleic acid encoding SV40LT. In embodiments, the expression of hTERT is regulated by an inducible expression system. In embodiments, the expression of SV40LT gene is regulated by an inducible expression system. In embodiments, the inducible expression system is rTTA-TRE, which increases or activates the expression of SV40LT gene or hTERT gene, or a combination thereof. In embodiments, the modified cells include a nucleic acid sequence encoding a suicide gene. In embodiments, the suicide gene includes a HSV-TK suicide gene system.

The present disclosure describes methods of treating cancer in a subject, the methods comprising administering a mixed population of modified cells described herein to the subject, wherein the cancer is selected from the group consisting of a lung carcinoma, pancreatic cancer, liver cancer, bone cancer, breast cancer, colorectal cancer, leukemia, ovarian cancer, lymphoma, and brain cancer.

The methods described herein include a modified T cell and/or modified NK cell comprising a reduced amount of one or more peptides including PD1, PDL1, PDL2, CTLA4, LRBA, LAG3, Tim3, BILA, CD160, 2B4, SOCS1, SOCS3, Foxp3, CCR4, PVRIG, CD16B, SIVA1, CD33, LAGLS9, CD122, IDO1, CD45, Cvp1b1, TNFAIP8L2, IDO2, TDO2, DNMT3A, and/or Ceacam-1 (list 1), as compared to a corresponding wild-type cell. In embodiments, the methods of treating cancer in a subject including enhancing the modified T cell and/or NK cell response of these T cells and/or NK cells (having a reduced amount of one or more peptides listed immediately above) when the mixed population of genetically modified T cells is administrated into a subject The methods include a modified T cell and/or modified NK cell comprising an increased amount of one or more peptides including Runx3, Iexm, PILRA, Ptnns1L3, Fcgr3a, Nat8, Ccl9, Hck, Trem2, Ccl6, Cd36, Igf1, Ctss, Gzmc, Batf, Cxcl2, TNFAIP8L3, Il1b, TRPV1, TRPV2, TRPV3, TRPV4, Rgs1, PLSCR1, ITGB2, C3AR1, ITGA3, ITGA5, ITGAL, batf, batf3, Cxcl2, CARD11, and/or CD83 (list 2), as compared to a corresponding wild-type cell. In embodiments, the methods of treating cancer in a subject include enhancing the T cell and/or NK cell response of these T cells and/or NK cells (having an increased amount of the one or more peptides listed immediately above) when the modified T cells and/or modified NK cells are administrated to a subject. In embodiments, various gene editing techniques or overexpression techniques (e.g., Cas9, TALEN, and ZFN) may be used to regulate the functions of T cell and/or NK cell by knocking out/knocking down/overexpressing/inserting one or more genes encoding one or more peptides in list 1 or 2. For example, the genetically modified T cell has reduced or increased expression of one or more genes of a biosynthesis or transportation pathway of a peptide in list 1 and list 2 (see above), as compared to the corresponding wild-type cell.

In embodiments, the target gene is Runx3. For example, the modified T cells have increased expression of Runx3 as compared to the corresponding wild-type cell. In these instances, the increased expression of Runx3 may help, for example, the infiltration or long-term residence of the modified T cells within the tumor cells, therefore increasing T cell killing effects.

For example, T cell response in a subject refers to cell-mediated immunity associated with helper, killer, regulatory, and other types T cells. For example, T cell response may include activities such as assistance to other white blood cells in immunologic processes and identifying and destroying virus-infected cells and tumor cells. T cell response in the subject may be measured via various indicators such as a number of virus-infected cells and/or tumor cells that the T cells kill, an amount of cytokines that the T cells release in co-culturing with virus-infected cells and/or tumor cells, a level of proliferation of the T cells in the subject, a phenotype change of the T cells (e.g., changes to memory T cells), and the longevity or the length of the lifetime of the T cells in the subject.

T cell response also includes the release of cytokines. Although cytokine release is often associated with systemic inflammation and complication of disease, the release of cytokines appears to be also associated with the efficacy of a CAR T cell therapy. The release of cytokines may correlate with expansion and progressive immune activation of adoptively transferred cells, such as in CAR T cell therapy. The present disclosure describes the release of effector cytokines, such as IFN-γ, and pro- and anti-inflammatory cytokines, such as IL-6, in response to mixed population of modified T cells described herein, especially in response to the presence of a first CAR including an antigen binding domain for expanding cells and a second CAR or TCR including an antigen binding domain for killing a target cell. In embodiments, the present disclosure describes the release of IL-6 and IFN-γ in a subject introduced with the first CAR and second CAR or TCR described herein. In embodiments, the subject is in need of cancer treatment, and the cancer treatment is pancreatic cancer treatment. In embodiments, the present disclosure describes determining the efficacy or monitoring the efficacy of a CAR T cell therapy by measuring the level of cytokine release. In embodiments, the release of cytokines (e.g., IL-6 and/or IFN-γ) in the subject in response to CAR T cell therapy using mixed population of modified T cells described herein is more than that using T cells comprising the second CAR without the first CAR.

In embodiments, the modified cells described herein may further comprise a dominant negative variant of a receptor of programmed death 1 (PD-1), cytotoxic T lymphocyte antigen-4 (CTLA-4), B- and T-lymphocyte attenuator (BTLA), T cell immunoglobulin mucin-3 (TIM-3), lymphocyte-activation protein 3 (LAG-3), T cell immunoreceptor with Ig and ITIM domains (TIGIT), leukocyte-associated immunoglobulin-like receptor 1 (LAIRI), natural killer cell receptor 2B4 (2B4), or CD160 such that the T cell response induced by the mixed population of modified cells may be enhanced. In embodiments, the modified cells described herein may further comprise a nucleic acid sequence encoding a suicide gene, and/or a suicide gene comprising an HSV-TK suicide gene system such that the fate of the modified cell may be controlled. For example, the T cell may be induced to commit suicide if it imposes risks to the subject, and/or the subject encounters undesired situations. The present disclosure describes a composition comprising a mixed population of modified cells described herein. In embodiments, there is a first population of modified cells comprising a first CAR binding a first antigen, and a second population of modified cells comprising a second CAR or TCR binding a second antigen that is different from the first antigen. The first antigen can be an antigen of a WBC, such as a B cell, while the second antigen is a tumor antigen. The present disclosure describes a method of enhancing expansion and maintenance of the second population of modified cells for killing tumor cells. The method includes administering an effective amount of the composition comprising a mixed population of modified cells to a subject having a form of cancer associated with the tumor antigen which the second CAR recognizes and binds. Embodiments also include a method of enhancing T cell response in a subject or treating the subject having cancer. The method includes administering an effective amount of the composition described herein to the subject having a form of cancer associated with the tumor antigen which the second CAR recognizes and binds. Further the embodiments include a method of enhancing expansion and/or maintenance of modified cells in a subject, the method comprising: contacting T cells with a first vector comprising a first nucleic acid sequence encoding the first CAR and a second vector comprising a second nucleic acid sequence encoding the second CAR to obtain the composition described herein of a mixed population of modified cells; and administering an effective amount of the composition to the subject having a form of cancer associated with the tumor antigen which the second CAR recognizes and binds. Additional embodiments include a method of enhancing T cell response in a subject or treating the subject having cancer, the method comprising: contacting T cells with a first vector comprising a first nucleic acid sequence encoding the first CAR and a second vector comprising a second nucleic acid sequence encoding the second CAR to obtain the composition described herein of a mixed population of modified cells; and administering an effective amount of the composition to the subject having a form of cancer associated with the tumor antigen, which the second CAR recognizes and binds. Embodiments include a method of enhancing expansion and maintenance of the modified cells in a subject, the method comprising: administering an effective amount of the composition described herein of a mixed population of modified cells.

The present disclosure describes a composition including a population of modified cells including a first population of modified cells that comprises a first CAR without a second CAR, and/or a second population of modified cells that comprises a second CAR without a first CAR. The present disclosure also describes a composition including a population of modified cells comprising the first CAR and second CAR (in a single modified cell). In embodiments, the composition includes a first and a second population of modified cells and a third population of modified cells comprising one or more nucleic acid sequences encoding the first CAR and the second CAR in the same modified cell. In embodiments, the composition comprises a second population of modified cells, in the absence of a first population of genetically modified cells, and a third population of modified cells comprising one or more nucleic acid sequences encoding the first CAR and the second CAR in the same modified cells.

In embodiments, the first population of cells comprises the first CAR and the second CAR, and the second population of cells comprises the first CAR but does not comprise the second CAR. In embodiments, the first population of cells comprises the first CAR and the second CAR, and the second population of cells comprises the first CAR and the second CAR. In embodiments, first population of cells comprises the first CAR but does not comprise the second CAR, the second population of cells comprises the first CAR and the second CAR. In embodiments, the first population of cells comprises the first CAR but does not contain the second CAR, and the second population of cells comprise the second CAR but does comprise first CAR. In embodiments, first population of cells comprises the second CAR but does not comprise the first CAR and the second population of cells comprises the first CAR and the second CAR. In embodiments, the first population of cells comprises the first CAR but does not comprise the second CAR; the second population comprises a second CAR but does not comprise the first CAR; and a third population comprises the first CAR and the second CAR. As described above, the first CAR includes an antigen binding domain for expanding and/or maintaining the modified cells, and the second CAR includes an antigen binding domain for killing target cells, such as tumors.

In embodiments, the antigen binding domain binds an antigen that is or that comprises a cell surface molecule of a white blood cell (WBC), a tumor antigen, or a solid tumor antigen. In embodiments, the WBCs are T cells, NK cells, or dendritic cells.

In embodiments, the WBC is a granulocyte, a monocyte, or lymphocyte. In embodiments, the WBC is a B cell. In embodiments, the cell surface molecule or antigen of the B cell is CD19, CD22, CD20, BCMA, CD5, CD7, CD2, CD16, CD56, CD30, CD14, CD68, CD11b, CD18, CD169, CD1c, CD33, CD38, CD138, or CD13. In embodiments, the cell surface molecule or antigen of the B cell is CD19, CD20, CD22, or BCMA. In embodiments, the cell surface molecule or antigen of the B cell is CD19.

In embodiments, the tumor antigen is a solid tumor antigen. In embodiments, the solid tumor antigen is tMUC 1, PRLR, CLCA1, MUC12, GUCY2C, GPR35, CR1L, MUC 17, TMPRSS11B, MUC21, TMPRSS11E, CD207, SLC30A8, CFC1, SLC12A3, SSTR1, GPR27, FZD10, TSHR, SIGLEC15, SLC6A3, KISS1R, QRFPR, GPR119, CLDN6, UPK2, ADAM12, SLC45A3, ACPP, MUC21, MUC16, MS4A12, ALPP, CEA, EphA2, FAP, GPC3, IL13-Ra2, Mesothelin, PSMA, ROR1, VEGFR-II, GD2, FR-α, ErbB2, EpCAM, EGFRvIII, B7-H3, or EGFR. In embodiments, the solid tumor antigen is or comprises tumor associated MUC1 (tMUC1).

In embodiments, the CAR comprises the antigen binding domain, a transmembrane domain, a co-stimulatory domain, and a CD3 zeta domain. In embodiments, the co-stimulatory domain comprises the intracellular domain of CD27, CD28, 4-1BB, OX40, CD30, CD40, PD-1, ICOS, lymphocyte function-associated antigen-1 (LFA-1), CD2, CD7, LIGHT, NKG2C, B7-H3, a ligand that specifically binds with CD83, or a combination thereof. In embodiments, the second CAR includes a binding domain that binds tMUC1 and a costimulatory domain that includes an intracellular domain of CD28; and/or the first CAR includes a binding domain that binds CD19 and a co-stimulatory domain that includes an intracellular domain of 41-BB.

In embodiments, the first population of cells and/or the second population of cells further comprise a dominant negative form of a checkpoint protein or of the checkpoint protein's receptor present on T cells (e.g., PD-1). In embodiments, the first population of cells comprise a vector comprising a nucleic acid encoding the first CAR and the dominant negative form of PD-1.

In embodiments, the second CAR comprises a scFv binding tMUC1, an intracellular domain of 4-1BB or CD28, CD3 zeta domain, and the second CAR comprises a scFv binding CD19, an intracellular domain of 4-1BB or CD28, CD3 zeta domain. In embodiments, the first CAR comprises a scFv, which is SEQ ID NO: 5, and the second CAR comprise a scFv, which is the SEQ ID NO: 70. Corresponding sequences are listed in Table 4.

Embodiments relate to a method comprising administering an effective amount of the second population of T cells comprising a second CAR comprising a scFv binding tMUC1 to a patient having cancer. The second CAR may further comprise an intracellular domain of 4-1BB or CD28, CD3 zeta domain. In embodiments, the method further comprises administering an effective amount of the first population of T cells comprising a first CAR comprising a scFv binding CD19 to the patient, thereby enhancing expansion of the second population of T cells in the patient. The CAR may further comprise an intracellular domain of 4-1BB or CD28, and CD3 zeta domain.

In embodiments, the second CAR comprises the intracellular domain of CD28, and the first CAR comprises the intracellular domain of 4-1BB. In this instance, the first population of T cells comprising CD19 may cause less adverse effect on the patient (e.g., CRS), and/or the second population of T cells comprising tMUC1 may cause enhanced T cell response (e.g., killing) as compared to those of the second CAR comprising the intracellular domain of 4-1BB and/or the first CAR comprising the intracellular domain of CD28. In embodiments, the second CAR comprises the intracellular domain of CD28 such that the second population of T cells may cause enhanced T cell response (e.g., killing) as compared to that of the second CAR comprising the intracellular domain of 4-1BB. In embodiments, the first CAR comprises the intracellular domain of 4-1BB such that the first population of T cells may cause less adverse effect on the patient (e.g., CRS) as compared to that of the first CAR comprising the intracellular domain of CD28.

In some embodiments, the second population of cells comprises the scFv binding a solid tumor antigen but do not comprise the scFv binding a B cell antigen, and the first population of cells comprises the scFV binding an antigen different from the solid tumor antigen (e.g., a WBC antigen or a B cell antigen) but do not comprise the scFV binding the tumor antigen. In these instances, the T cell response of the patient induced by binding between the first population of T cells and the antigen (e.g., CD19) may cause both the first and second populations of T cells to expand. Accordingly, the patient may be administered with a mixed population of genetically engineered T cells consisting essentially of the first population of cells and the second population of cells. In embodiments, the patient may be administered with the second population of genetically engineered T cells and one or more recombinant proteins (e.g., cytokine such as IL6 and/or INFγ) or cells expressing and secretion of the one or more recombinant proteins, which may induce similar or enhanced T cell response caused by the first population of T cells. In embodiments, the patient may be administered with the second population of T cells and a hormone drug (e.g., fulvestrant), which may induce similar or enhanced T cell response caused by the first population of T cells.

In embodiments, the first population of modified cells can further comprise a third CAR comprising the scFv binding tMUC1, the intracellular domain of 4-1BB or CD28, and the CD3 zeta domain. In embodiments, the second population of cells does not comprise the scFv binding CD19. In embodiments, the first population of cells does not comprise the scFv binding tMUC1.

The present disclosure is further described by reference to the following exemplary embodiments and examples. These exemplary embodiments and examples are provided for purposes of illustration only and are not intended to be limiting unless otherwise specified. Thus, the present disclosure should in no way be construed as being limited to the following exemplary embodiments and examples, but rather, should be construed to encompass any and all variations which become evident as a result of the teaching provided herein.

Exemplary Embodiments

The following are exemplary embodiments:

1. A nucleic acid encoding a first chimeric antigen receptor (CAR) and a second CAR, wherein a binding domain of the first CAR binds a cell surface molecule of a white blood cell (WBC), and a binding domain of the second CAR binds an antigen different from the cell surface molecule of a WBC.

2. A vector comprising the nucleic acid of embodiment 1.

3. A cell comprising the nucleic acid of embodiment 1.

4. A cell comprising a first CAR and a second CAR, wherein a binding domain of the first CAR binds a cell surface molecule of a cell surface molecule of a WBC, and a binding domain of the second CAR binds an antigen different from the cell surface molecule of a WBC.

5. The cell of any one of embodiments 1-4, wherein the cell is a T cell, NK cell, or dendritic cells.

6. A composition comprising a population of the cells of any one of embodiments 3-5.

7. A method of culturing the cells of any one of embodiments 3-5, the method comprising: obtaining the cell of any one of embodiments 3-5, wherein a binding domain of the first CAR binds a cell surface molecule of a cell surface molecule of a WBC, and a binding domain of the second CAR binds an antigen different from the cell surface molecule of a WBC; and culturing the cell in the presence of an agent derived from the cell surface molecule of the WBC cell or from an antigen to which a second CAR binds.

8. The method of embodiment 7, wherein the agent is an extracellular domain of the cell surface molecule of the WBC.

9. A method for in vitro CAR cell preparation, the method comprising:
providing cells;
introducing a nucleic acid encoding a first CAR and a second CAR into the cells, wherein a binding domain of the first CAR binds a cell surface molecule of a WBC, and a binding domain of the second CAR binds an antigen different from the cell surface molecule of the WBC; and culturing the cells in the presence of an agent derived from the cell surface molecule of the WBC or from an antigen to which the second CAR binds.

10. A method of enhancing T cell response in a subject or treating a tumor of the subject, the method comprising: administering an effective amount of T cell comprising a first CAR and a second CAR to the subject to provide a T cell response, wherein a binding domain of the first CAR binds a cell surface molecule of a WBC, and a binding domain of the second CAR binds an antigen different from the cell surface molecule of the WBC, and wherein the T cell response is measured by the number of copies of CAR(s) and/or the amount of cytokine released (e.g., IL-6 and IFN-γ). In embodiments, the T cell response is enhanced as compared to T cells that include the second CAR but don't comprise the first CAR.

11. The method of embodiment 10, wherein enhancing the T cell response in the subject comprises selectively enhancing proliferation of T cell comprising the first and second CARs in vivo.

12. A method of expanding cells expressing CAR in vivo, the method comprising: administering an effective amount of T cell comprising a first CAR and a second CAR to the subject, wherein a binding domain of the first CAR binds a cell surface molecule of a WBC, and a binding domain of the second CAR binds an antigen different from the cell surface molecule of the WBC, the cells being T cells, NK cells, or dendritic cells.

13. The nucleic acid, the vector, the cell, the composition, or the method of any one of embodiments 1-12, wherein the antigen different from the cell surface molecule of the WBC is CD19, CD22, CD20, BCMA, CD5, CD7, CD2, CD16, CD56, CD30, CD14, CD68, CD11b, CD18, CD169, CD1c, CD33, CD38, CD138, CD13, B7, CAIX, CD123, CD133, CD171, CD171/L1-CAM, CEA, Claudin 18.2, cMet, CS1, CSPG4, Dectin1, EGFR, EGFR vIII, EphA2, ERBB receptors, ErbB T4, ERBB2, FAP, Folate receptor 1, FITC, Folate receptor 1, FSH, GD2, GPC3, HA-1 H/HLA-A2, HER2, IL-11Ra, IL13 receptor a2, IL13R, IL13Ra2 (zetakine), Kappa, Leukemia, LewisY, Mesothelin, MUC1, NKG2D, NY-ESO-1, PSMA, ROR-1, TRAIL-receptor1, or VEGFR2.

14. The nucleic acid, the vector, the cell, the composition, or the method of embodiment 13, wherein the MUC1 is a tumor-exclusive epitope of a human MUC1, and the first CAR and the second CAR are expressed as separate polypeptides.

15. The nucleic acid, the vector, the cell, the composition, or the method of embodiment 13, wherein the MUC1 is a tumor form of human MUC1 (tMUC1).

16. The nucleic acid, the vector, the cell, the composition, or the method of any one of embodiments 1-12, wherein the WBC is a granulocyte, a monocyte, or lymphocyte.

17. The nucleic acid, the vector, the cell, the composition, or the method of any one of embodiments 1-12, wherein the WBC is a B cell.

18. The nucleic acid, the vector, the cell, the composition, or the method of any one of embodiments 1-12, wherein the cell surface molecule of the WBC is CD19, CD22, CD20, BCMA, CD5, CD7, CD2, CD16, CD56, CD30, CD14, CD68, CD11b, CD18, CD169, CD1c, CD33, CD38, CD138, or CD13.

19. The nucleic acid, the vector, the cell, the composition, or the method of any one of embodiments 1-12, wherein the cell surface molecule of the WBC is CD19, CD20, CD22, or BCMA.

20. The nucleic acid, the vector, the cell, the composition, or the method of any one of embodiments 1-12, wherein the cell surface molecule of the WBC is CD19.

21. The nucleic acid, the vector, the cell, the composition, or the method of any one of embodiments 1-12, wherein the first CAR comprises the first antigen binding domain, a transmembrane domain, a co-stimulatory domain, and a CD3 zeta domain; and/or the second CAR comprises the second antigen binding domain, a transmembrane domain, a co-stimulatory domain, and a CD3 zeta domain.

22. The nucleic acid, the vector, the cell, the composition, or the method of any one of embodiments 1-12, wherein the co-stimulatory domain comprises the intracellular domain of CD27, CD28, 4-1BB, OX40, CD30, CD40, PD-1, ICOS, lymphocyte function-associated antigen-1 (LFA-1), CD2, CD7, LIGHT, NKG2C, B7-H3, a ligand that specifically binds with CD83, or a combination thereof.

23. The nucleic acid, the vector, the cell, the composition, or the method of any one of embodiments 1-12, wherein the antigen binding domain is a Fab or a scFv.

24. The nucleic acid, the vector, the cell, the composition, or the method of any one of embodiments 1-12, wherein the first CAR comprises the amino acid sequence of SEQ ID NO: 5, 6, 53 and 54, 55 and 56, or 57 and 58, and the second CAR comprises the amino acid sequence of SEQ ID NO: 5-17, 29, 33, 37, 71, or 72, or the amino acid sequence encoded by nucleic acid sequence SEQ ID NO: 41, 45, 63, 67, or 68.

25. The nucleic acid, the vector, the cell, the composition, or the method of any one of embodiments 1-12, wherein a nucleic acid encoding the first CAR comprises the nucleic acid sequence of SEQ ID NO: 59, or 60, and a nucleic acid sequence encoding the second CAR comprises the nucleic acid sequence of SEQ ID NO: 61.

26. The nucleic acid, the vector, the cell, the composition, or the method of any one of embodiments 1-12, wherein the nucleic acid comprises one of the nucleic acid sequences of SEQ ID NO: 62-69.

27. The nucleic acid, the vector, the cell, the composition, or the method of any one of embodiments 1-12, wherein the first CAR and the second CAR are expressed as separate polypeptides.

28. A modified T cell comprising a first CAR and a second CAR, wherein a binding domain of the first CAR binds CD19, and a binding domain of the second CAR binds tumor associated MUC1.

29. The modified T cell of embodiment 28, wherein the binding domain of the second CAR comprises:
   (i) a heavy chain complementary determining region 1 comprising the amino acid sequence of SEQ ID: 76 or 85, a heavy chain complementary determining region 2 comprising the amino acid sequence of SEQ ID: 77 or 86, and a heavy chain complementary determining region 3 comprising the amino acid sequence of SEQ ID: 78 or 87; and (ii) a light chain complementary determining region 1 comprising the amino acid sequence of SEQ ID: 73 or 82, a light chain complementary determining region 2 comprising the amino acid sequence of TRP-ALA-SER (WAS) or SEQ ID: 83, and a light chain complementary determining region 3 comprising the amino acid sequence of SEQ ID: 75 or 84.

30. The modified T cell of embodiment 28, wherein the binding domain of the second CAR comprises:
   (i) a heavy chain complementary determining region 1 comprising the amino acid sequence of SEQ ID: 76, a heavy chain complementary determining region 2 comprising the amino acid sequence of SEQ ID: 77, and a heavy chain complementary determining region 3 comprising the amino acid sequence of SEQ ID: 78; and (ii) a light chain complementary determining region 1 comprising the amino acid sequence of SEQ ID: 73, a light chain complementary determining region 2 comprising the amino acid sequence of TRP-ALA-SER (WAS), and a light chain complementary determining region 3 comprising the amino acid sequence of SEQ ID: 75.

31. The modified T cell of embodiment 28, wherein the binding domain of the second CAR comprises: (i) a heavy chain complementary determining region 1 comprising the amino acid sequence of SEQ ID: 85, a heavy chain complementary determining region 2 comprising the amino acid sequence of SEQ ID: 86, and a heavy chain complementary determining region 3 comprising the amino acid sequence of SEQ ID: 87; and (ii) a light chain complementary determining region 1 comprising the amino acid sequence of SEQ ID: 82, a light chain complementary determining region 2 comprising the amino acid sequence of SEQ ID: 83, and a light chain complementary determining region 3 comprising the amino acid sequence of SEQ ID: 84.

32. The modified T cell of embodiment 28, wherein the binding domain of the first CAR comprises the amino acid sequence of SEQ ID: 5 or 6.

33. The modified T cell of embodiment 28, wherein the binding domain of the second CAR comprises one of the amino acid sequences of SEQ ID: 70-72 and 79-81.

34. The modified T cell of any one of embodiments 28-33, wherein the first CAR comprises the first antigen binding domain, a transmembrane domain, a co-stimulatory domain, and a CD3 zeta domain and/or the second CAR comprises the second antigen binding domain, a transmembrane domain, a co-stimulatory domain, and a CD3 zeta domain.

35. The modified T cell of embodiment 34, wherein the co-stimulatory domain comprises the intracellular domain of CD27, CD28, 4-1BB, OX40, CD30, CD40, PD-1, ICOS, lymphocyte function-associated antigen-1 (LFA-1), CD2, CD7, LIGHT, NKG2C, B7-H3, a ligand that specifically binds with CD83, or a combination thereof.

36. The modified T cell of any one of embodiments 28-35, wherein the first CAR and the second CAR are expressed as gene products that are separate polypeptides.

37. The modified T cell of any one of embodiments 28-35, wherein a cytoplasmic domain or a transmembrane domain of the second CAR is modified such that the second CAR is capable of activating the modified T cell via cells expressing CD19 without damaging the cells expressing CD19.

38. A bispecific CAR, comprising:
a first antigen binding domain, a second antigen binding domain, a cytoplasmic domain, and a transmembrane domain, wherein the first antigen binding domain recognizes a first antigen, the second antigen binding domain recognize a second antigen, and the first antigen is different from the second antigen.

39. The bispecific CAR of embodiment 38, wherein the first antigen and the second antigen are not expressed on the same cell.

40. The bispecific CAR of embodiment 38, wherein the first antigen is an antigen of a blood component, and the second antigen is an antigen of a solid tumor.

41. The bispecific CAR of embodiment 38, wherein the first antigen is CD19, and the second antigen is a tumor associated MUC1.

42. The bispecific CAR of embodiment 38, wherein the first antigen binding domain comprises amino acid sequence of SEQ ID: 5 or 6.

43. The modified T cell of embodiment 28, wherein the second antigen binding domain comprises one of the amino acid sequences of SEQ ID: 70-72 and 79-81.

44. A method of enhancing T cell response in a subject or treating a tumor of the subject, the method comprising: administering an effective amount of the modified T cell of any one of embodiments 28-37 to the subject to provide a T-cell response such that the modified T cell is expanded in the blood of the subject via cells expressing CD19.

45. The modified T cell of any one of embodiments 28-37, wherein the tumor associated MUC1 is expressed on tumor cells and not on corresponding non-malignant cells.

46. The modified T cells of any one of embodiments 28-37, wherein the binding domain of the second CAR comprises a scFv against the tumor associated MUC1 that directly interacts with an o-glycosylated GSTA motif (SEQ ID NO: 88).

47. A cell comprising the bispecific CAR of any one of embodiments 38-43.

48. A nucleic acid encoding the bispecific CAR of any one of embodiments 38-43.

49. A nucleic acid encoding a first CAR and a second CAR, wherein a binding domain of the first CAR binds an antigen selected from the group consisting of CD19, CD33, CD14, and BCMA, and a binding domain of the second CAR binds a tumor associated MUC1.

50. A T cell comprising a first CAR and a second CAR, wherein a binding domain of the first CAR binds an antigen selected from the group consisting of CD19, CD33, CD14, and BCMA, a binding domain of the second CAR binds a tumor associated MUC1.

51. A T cell comprising a first nucleic acid encoding a first CAR and a second nucleic acid encoding a second CAR, wherein a binding domain of the first CAR binds an antigen selected from the group consisting of CD19, CD33, CD14, and BCMA, a binding domain of the second CAR binds a tumor associated MUC1.

52. A composition comprising a population of the T cells of embodiment 50 or 51.

53. The T cell of embodiment 50 or 51, wherein the first CAR and the second CAR are expressed as separate polypeptides.

54. The nucleic acid of embodiment 1 or the T cell of embodiment 50 or 51, wherein the nucleic acid comprises one of the nucleic acid sequences of SEQ ID NO: 201, 204, 206, 208, 209, 211, 213-215, 217, 218, 220, 222-225, 227, 228, 230-235, 237, 238, 240-244, 247, 249-254, 256, 257, 259, and 260-263.

55 The nucleic acid of embodiment 49 or the T cell of embodiment 50 or 51, wherein the nucleic acid comprises one of the nucleic acid sequences of SEQ ID NO: 201, 204, 206, 208, 215, 217, 218, and 220.

56. The nucleic acid of embodiment 49 or the cell of embodiment 50 or 51, wherein the first CAR comprises the amino acid sequence of SEQ ID NO: 203, 207, 216, 219, 226, 229, 236, 239, 245, 248, 255, or 258, and the second CAR comprises the amino acid sequence of SEQ ID: 202, 205, 210, or 212.

57. The nucleic acid of embodiment 49 or the cell of embodiment 50 or 51, wherein the first CAR comprises the amino acid sequence of SEQ ID NO: 207, and the second CAR comprises the amino acid sequence of SEQ ID NO: 202.

58. The nucleic acid of embodiment 49 or the cell of embodiment 50 or 51, wherein the first CAR comprises the amino acid sequence of SEQ ID NO: 203, 207, 216, or 219, and the second CAR comprises the amino acid sequence of SEQ ID NO: 202 or 205.

59. A vector comprising the nucleic acid of embodiment 49.

60. A cell comprising the nucleic acid of embodiment 49.

61. A composition comprising a population of the cells of embodiment 60.

62. The cell of embodiments 60 or 61, wherein the cell is a T cell, NK cell, or dendritic cells.

63. A modified T cell comprising one or more nucleic acids encoding a CAR and one or more TCR chains or a TCR of an innate T cell.

64. The modified T cell of embodiment 63, wherein the nucleic acid encoding the one or more TCR chains or a TCR of an innate T cell is a nucleic acid insert within a target genomic locus.

65. The modified T cell of embodiment 63, wherein integration of the nucleic acid insert causes replacement of at least of a portion of a gene at the target genomic locus.

66. The modified T cell of embodiment 63, wherein the nucleic acid is introduced into the T cell using a nuclease agent.

67. A method of modifying a target genomic locus in a T cell, the method comprising: introducing into the T cell a nuclease agent that makes a single or double-strand break within the target genomic locus; and introducing into the T cell a nucleic acid insert comprising a nucleic acid encoding one or more TCR chains or a TCR of an innate T cell; and selecting the T cell comprising the nucleic acid insert integrated into the target genomic locus.

68. The method of embodiment 67, wherein the nucleic acid insert is flanked by a 5' homology arm and a 3' homology arm, and the 3' homology arm of the nucleic acid insert and the 5' homology arm of the nucleic acid insert are homologous to corresponding genomic segments within the target genomic locus.

69. The method of embodiment 67, wherein the target genomic locus is modified by integration of the nucleic acid insert between the corresponding genomic segments.

70. The method of embodiment 67, wherein the nuclease agent is a zinc finger nuclease (ZFN), a Transcription Activator-Like Effector Nuclease (TALEN), or a meganuclease.

71. The method of embodiment 67, wherein the nuclease agent comprises a Clustered Regularly Interspaced Short Palindromic Repeats (CRISPR)-associated (Cas) protein and a guide RNA (gRNA).

72. The method of embodiment 71, wherein the Cas protein is Cas9.

73. The modified T cell or the method of any one of embodiments 63-72, wherein the innate T cell comprises a γσ T cell, an INKT cell, or a MAIT cell.

74. The modified T cell or the method of any one of embodiments 63-72, wherein the innate T cell comprises a γσ T cell.

75. The modified T cell or the method of any one of embodiments 63-72, wherein the innate T cell comprises a Vγ9Vσ2 T cell.

76. The modified T cell or the method of embodiment 75, wherein the one or more nucleic acids encoding one or more TCR chains encodes a TCR γ chain and a TCR σ chain.

77. The modified T cell or the method of embodiment 75, wherein the one or more nucleic acids encoding one or more TCR chains encodes an endogenous TCR γ chain and an endogenous TCR σ chain.

78. The modified T cell or the method of embodiment 75, wherein the nucleic acid insert comprises a nucleic acid that corresponds to one or more the amino acid sequences of SEQ ID No.: 99 and 185, or a combination thereof.

79. The modified T cell or the method of any one of embodiments 63-72, wherein the innate T cell comprises an INKT cell.

80. The modified T cell or the method of embodiment 79, wherein the nucleic acid encoding the TCR of an innate T cell encodes an INKT α chain and/or an INKT β chain.

81. The modified T cell or the method of embodiment 79, wherein the nucleic acid encoding the TCR of an innate T cell encodes an endogenous INKT α chain or an endogenous INKT β chain.

82. The modified T cell or the method of any one of embodiments 63-72, wherein the innate T cell comprises a MAIT cell.

83. The modified T cell or the method of embodiment 82, wherein the nucleic acid encoding the TCR of an innate T cell encodes a MAIT α chain and/or a MAIT β chain.

84. The modified T cell or the method of embodiment 82, wherein the nucleic acid encoding the TCR of an innate T cell encodes an endogenous MAIT α chain or an endogenous MAIT β chain.

85. The modified T cell or the method of any one of embodiments 63-84, wherein the target genomic locus is a or β TCR gene locus of an αβ T cell.

86. The modified T cell or the method of any one of embodiments 63-84, wherein the integration of the nucleic acid insert causes replacement a sequence at α or β TCR gene locus of an αβ T cell such that expression of overall endogenous TCR is not reduced.

87. The modified T cell or the method of any one of embodiments 63-84, wherein corresponding genomic segments of the target genomic locus comprise the amino acid sequence of a chain of TCR.

88. The modified T cell or the method of any one of embodiments 63-84, wherein the genetically modified cell elicits a reduced graft versus host disease response against allogeneic cells as compared to a corresponding cell that does not include nucleic acid sequence.

89. The modified T cell or the method of any one of embodiments 63-84, wherein the T cell is a T cell derived from a primary human T cell isolated from a human donor.

90. The modified T cell or the method of any one of embodiments 63-84, wherein the T cell comprises a CAR.

91. The modified cell or the method of any one of embodiments 63-90, wherein the genetically modified cell has functional TCRs comprising the one or more TCR chains.

92. The modified cell or the method of any one of embodiments 63-90, wherein the TCR of the innate T cells and αβ TCR originate from the donor.

93. The modified cell or the method of any one of embodiments 63-92, wherein the innate T cell exhibits a non-MHC class I or II restriction requirement for antigen recognition.

94. A method of causing a T-cell response in a subject or treating a tumor of the subject, the method comprising: administering an effective amount of the T cell of any one of embodiments 63-92.

95. A nucleic acid encoding a binding molecule comprising a first domain and a second binding domain, wherein the first binding domain and the second binding domain bind to an antigen.

96. The nucleic acid of embodiment 95, wherein one or more targeting antigen binding sites of the first binding domain and the second binding domain are different, and the binding molecule is a CAR comprising the first binding domain, a linker, the second binding domain, a transmembrane domain, and a co-stimulatory domain and/or a CD3 zeta domain.

97. The nucleic acid of embodiment 95, wherein the antigen is Epidermal growth factor receptor (EGFR), Variant lll of the epidermal growth factor receptor (EGFRvIII), Human epidermal growth factor receptor 2 (HER2), Mesothelin (MSLN), Prostate-specific membrane antigen (PSMA), Carcinoembryonic antigen (CEA), Disialoganglioside 2 (GD2), Interleukin-13Ra2 (IL13Ra2), Glypican-3 (GPC3), Carbonic anhydrase IX (CAIX), L1 cell adhesion molecule (L1-CAM), Cancer antigen 125 (CA125), Cluster of differentiation 133 (CD133), Fibroblast activation protein (FAP), Cancer/testis antigen 1B (CTAG1B), Mucin 1 (MUC1), Folate receptor-α (FR-α), CD19, FZD10, TSHR, PRLR, Mucin 17 (MUC17), GUCY2C, CD207, CD3, CD5, B-Cell Maturation Antigen (BCMA), or CD4.

98. The nucleic acid of embodiment 95, wherein the first binding domain binds tumor associated Muc1, TSHR, FZD10, PRLR, Mucin 16 (MUC16), MUC17, GUCY2C, CD207, CLDN18.2, CLDN6, or SIGL1C.

99. The nucleic acid of embodiment 95, wherein the nucleic acid encodes a polypeptide comprising one of the amino acid sequences of SEQ ID NO: 264 and 265.

100. A vector comprising a nucleic acid of any one of embodiments 95-99.

101. A host cell transformed or transfected with the nucleic acid of any one of embodiments 95-99 or with the vector of embodiment 100.

102. A method for the production of a binding molecule encoded by the nucleic acid of any one of embodiments 95-99, the method comprising culturing a host cell of embodiment 101 under conditions allowing expression of the binding molecule of any one of embodiments 95-99 and recovering the binding molecule from the culture.

103. A pharmaceutical composition comprising a binding molecule encoded by the nucleic acid of any one of embodiments 95-99 or produced according to the method of embodiment 102.

104. A kit comprising a binding molecule encoded by the nucleic acid of any one of embodiments 95-99, a nucleic acid of any one of embodiments 95-99, a vector of embodiment 100, and/or a host cell of embodiment 101.

105. A method for the treatment or amelioration of a disease, comprising administering to a subject in need thereof the binding molecule encoded by the nucleic acid of any one of embodiments 95-99.

106. A nucleic acid encoding a first antigen binding molecule and a second antigen binding molecule, wherein a binding domain of the first antigen binding molecule binds a cell surface molecule of a WBC, and a binding domain of the second antigen binding molecule binds a solid tumor antigen that is different from the cell surface molecule of the WBC.

107. A vector comprising the nucleic acid of embodiment 106.

108. A cell comprising the nucleic acid of embodiment 106.

109. A cell comprising a first antigen binding molecule and a second antigen binding molecule, wherein a binding domain of the first antigen binding molecule binds a cell surface molecule of a WBC, and a binding domain of the second antigen binding molecule binds a solid tumor antigen that is different from the cell surface molecule of a WBC.

110. A composition comprising a population of the cell of any one of embodiments 108-109.

111. The cell of any one of embodiments 108-109, wherein the cell is a T cell, NK cell, or dendritic cells.

112. A method of culturing cells, the method comprising: obtaining a cell comprising a first antigen binding molecule and a second antigen binding molecule, wherein a binding domain of the first antigen binding molecule binds a cell surface molecule of a WBC, and a binding domain of the second antigen binding molecule binds a solid tumor antigen that is different from the cell surface molecule of the WBC; and culturing the cell in the presence of an agent derived from the cell surface molecule of the WBC or from an antigen to which the second antigen binding molecule binds.

113. The method of embodiment 112, wherein the agent is an extracellular domain of the cell surface molecule of the WBC.

114. A method for in vitro cell preparation, the method comprising: preparing cells; introducing a nucleic acid encoding a first antigen binding molecule and a second antigen binding molecule into the cells, a binding domain of the first antigen binding molecule binding to a cell surface molecule of a WBC, and a binding domain of the second antigen binding molecule binding to an antigen different from the cell surface molecule of the WBC; and culturing the cells in the presence of an agent derived from the cell surface molecule of the WBC or from an antigen to which the second antigen binding molecule binds.

115. A method of enhancing T cell response in a subject or treating a tumor of the subject, the method comprising: administering an effective amount of T cell comprising a first antigen binding molecule and a second antigen binding molecule to the subject to provide a T cell response, wherein a binding domain of the first antigen binding molecule binds a cell surface molecule of a WBC, and a binding domain of the second antigen binding molecule binds an antigen different from the cell surface molecule of the WBC.

116. The method of embodiment 115, wherein enhancing T cell response in the subject comprises selectively enhancing proliferation of T cell comprising the first antigen binding molecule and the second antigen binding molecule in vivo.

117. A method of expanding cells expressing an antigen binding molecule in vivo, the method comprising: administering an effective amount of T cell comprising a first antigen binding molecule and a second antigen binding molecule to the subject, wherein a binding domain of the first antigen binding molecule binds a cell surface molecule of a WBC, and a binding domain of the second antigen binding molecule binds a solid tumor antigen that is different from the cell surface molecule of the WBC, the cells being T cells, NK cells, or dendritic cells.

118. The nucleic acid, the vector, the cell, or the method of any one of embodiments 106-117, wherein the first antigen binding molecule is a first chimeric antigen receptor (CAR) and the second antigen binding molecule is a second CAR.

119. The nucleic acid, the vector, the cell, or the method of embodiment 118, wherein the antigen different from the cell surface molecule of the WBC is CD19, CD22, CD20, BCMA, CD5, CD7, CD2, CD16, CD56, CD30, CD14, CD68, CD11b, CD18, CD169, CD1c, CD33, CD38, CD138, CD13, B7, CAIX, CD123, CD133, CD171, CD171/L1-CAM, CEA, Claudin 18.2, cMet, CS1, CSPG4, Dectin1, EGFR, EGFR vIII, EphA2, ERBB receptors, ErbB T4, ERBB2, FAP, Folate receptor 1, FITC, Folate receptor 1, FSH, GD2, GPC3, HA-1 H/HLA-A2, HER2, IL-11Ra, IL13 receptor a2, IL13R, IL13Ra2 (zetakine), Kappa, Leukemia, LewisY, Mesothelin, MUC1, NKG2D, NY-ESO-1, PSMA, ROR-1, TRAIL-receptor1, or VEGFR2.

120. The nucleic acid, the vector, the cell, or the method of embodiment 118, wherein the MUC1 is a tumor-exclusive epitope of a human MUC1, and the first CAR and the second CAR are expressed as polypeptides.

121. The nucleic acid, the vector, the cell, or the method of embodiment 118, wherein the MUC1 is a tumor form of human MUC1 (tMUC1).

122. The nucleic acid, the vector, the cell, or the method of embodiment 118, wherein the WBC is a granulocyte, a monocyte and or lymphocyte.

123. The nucleic acid, the vector, the cell, or the method of embodiment 118, wherein the WBC is a B cell.

124. The nucleic acid, the vector, the cell, or the method of embodiment 118, wherein the cell surface molecule of the WBC is CD19, CD22, CD20, BCMA, CD5, CD7, CD2, CD16, CD56, CD30, CD14, CD68, CD11b, CD18, CD169, CD1c, CD33, CD38, CD138, or CD13, or the cell surface molecule of the WBC is CD19, CD20, CD22, or BCMA.

125. The nucleic acid, the vector, the cell, or the method of embodiment 118, wherein the cell surface molecule of the WBC is CD19.

126. The nucleic acid, the vector, the cell, or the method of embodiment 118, wherein the first CAR comprises the first antigen binding domain, a transmembrane domain, a co-stimulatory domain, and a CD3 zeta domain and/or the second CAR comprises the second antigen binding domain, a transmembrane domain, a co-stimulatory domain, and a CD3 zeta domain.

127. The nucleic acid, the cell, or the method of embodiment 110, wherein the co-stimulatory domain comprises the intracellular domain of a co-stimulatory molecule selected from the group consisting of CD27, CD28, 4-1BB, OX40, CD30, CD40, PD-1, ICOS, lymphocyte function-associated antigen-1 (LFA-1), CD2, CD7, LIGHT, NKG2C, B7-H3, a ligand that specifically binds with CD83, or a combination thereof.

128. The nucleic acid, the vector, the cell, or the method of embodiment 118, wherein the antigen binding domain is a Fab or a scFv.

129. The nucleic acid, the vector, the cell, or the method of embodiment 118, wherein the first CAR comprises the amino acid sequence of SEQ ID NO: 5, 6, 53 and 54, 55 and 56, or 57 and 58, and the second CAR comprises the amino acid sequence of one of SEQ ID NOs: 5-17, 29, 33, 37, 71, and 72, or the amino acid sequence encoded by the nucleic acid of SEQ ID NO: 41, 45, 63, 67, or 68.

130. The nucleic acid, the vector, the cell, or the method of embodiment 118, wherein a nucleic acid encoding the first CAR comprises the nucleic acid sequence of SEQ ID NO: 59, or 60, and a nucleic acid encoding the second CAR comprises the nucleic acid sequence of SEQ ID NO: 61.

131. The nucleic acid, the vector, the cell, or the method of embodiment 118, wherein the nucleic acid comprises one of the nucleic acid sequence of SEQ ID NO: 62-69.

132. The nucleic acid, the vector, the cell, or the method of embodiment 118, wherein the first CAR and the second CAR are expressed as gene products that are separate polypeptides. 133. The nucleic acid, the vector, the cell, or the method of any one of embodiments 106-132, wherein the first antigen binding molecule is a chimeric antigen receptor (CAR) and the second antigen binding molecule is a T Cell Receptor (TCR).

134. The nucleic acid, the vector, the cell, or the method of embodiment 133, wherein the TCR is modified TCR.

135. The nucleic acid, the vector, the cell, or the method of embodiment 133, wherein the TCR is derived from spontaneously occurring tumor-specific T cells in patients.

136. The nucleic acid, the cell, or the method of embodiment 133, wherein the TCR binds a tumor antigen.

137. The nucleic acid, the vector, the cell, or the method of embodiment 133, wherein the tumor antigen comprises CEA, gp100, MART-1, p53, MAGE-A3, or NY-ESO-1, or the TCR comprises TCRγ and TCRσ Chains or TCRα and TCRβ chains, or a combination thereof.

138. A modified T cell comprising a first CAR and a second CAR, wherein a binding domain of the first CAR binds CD19, and a binding domain of the second CAR binds tumor associated MUC1.

139. The modified T cell of embodiment 138, wherein the binding domain of the second CAR comprises: (i) a heavy chain complementary determining region 1 comprising the amino acid sequence of SEQ ID: 76 or 85, a heavy chain complementary determining region 2 comprising the amino acid sequence of SEQ ID: 77 or 86, and a heavy chain complementary determining region 3 comprising the amino acid sequence of SEQ ID: 78 or 87; and (ii) a light chain complementary determining region 1 comprising the amino acid sequence of SEQ ID: 73 or 82, a light chain complementary determining region 2 comprising the amino acid sequence of TRP-ALA-SER (WAS) or SEQ ID: 83, and a light chain complementary determining region 3 comprising the amino acid sequence of SEQ ID: 75 or 84.

140. The modified T cell of embodiment 138, wherein the binding domain of the second CAR comprises: (i) a heavy chain complementary determining region 1 comprising the amino acid sequence of SEQ ID: 76, a heavy chain complementary determining region 2 comprising the amino acid sequence of SEQ ID: 77, and a heavy chain complementary determining region 3 comprising the amino acid sequence of SEQ ID: 78; and (ii) a light chain complementary determining region 1 comprising the amino acid sequence of SEQ ID: 73, a light chain complementary determining region 2 comprising the amino acid sequence of TRP-ALA-SER (WAS), and a light chain complementary determining region 3 comprising the amino acid sequence of SEQ ID: 75.

141. The modified T cell of embodiment 138, wherein the binding domain of the second CAR comprises: (i) a heavy chain complementary determining region 1 comprising the amino acid sequence of SEQ ID: 85, a heavy chain complementary determining region 2 comprising the amino acid sequence of SEQ ID: 86, and a heavy chain complementary determining region 3 comprising the amino acid sequence of SEQ ID: 87; and (ii) a light chain complementary determining region 1 comprising the amino acid sequence of SEQ ID: 82, a light chain complementary determining region 2 comprising the amino acid sequence of SEQ ID: 83, and a light chain complementary determining region 3 comprising the amino acid sequence of SEQ ID: 84.

142. The modified T cell of embodiment 138, wherein the binding domain of the first CAR comprises the amino acid sequence of SEQ ID: 5 or 6.

143. The modified T cell of embodiment 138, wherein the binding domain of the second CAR comprises one of the amino acid sequences of SEQ ID: 70-72 and 79-81.

144. The modified T cell of any one of embodiments 138-143, wherein the first CAR comprises the first antigen binding domain, a transmembrane domain, a co-stimulatory domain, and a CD3 zeta domain and/or the second CAR comprises the second antigen binding domain, a transmembrane domain, a co-stimulatory domain, and a CD3 zeta domain.

145. The modified T cell of embodiment 144, wherein the co-stimulatory domain comprises the intracellular domain of a co-stimulatory molecule selected from the group consisting of CD27, CD28, 4-1BB, OX40, CD30, CD40, PD-1, ICOS, lymphocyte function-associated antigen-1 (LFA-1), CD2, CD7, LIGHT, NKG2C, B7-H3, a ligand that specifically binds with CD83, or a combination thereof.

146. The modified T cell of any one of embodiments 138-145, wherein the first CAR and the second CAR are expressed as gene products that are separate polypeptides.

147. The modified T cell of any one of embodiments 138-146, wherein a cytoplasmic domain or a transmembrane domain of the second CAR is modified such that the second CAR is capable of activating the modified T cell via cells expressing CD19 without damaging the cells expressing CD19.

148. A bispecific chimeric antigen receptor, comprising: a first antigen binding domain, a second antigen binding domain, a cytoplasmic domain, and transmembrane domain, wherein the first antigen binding domain recognizes a first antigen, and the second antigen binding domain recognize a second antigen, the first antigen is different from the second antigen.

149. The bispecific chimeric antigen receptor of embodiment 148, wherein the first antigen and the second antigen are not expressed on the same cell.

150. The bispecific chimeric antigen receptor of embodiment 148 or 149, wherein the first antigen is an antigen of a blood component, and the second antigen is an antigen of a solid tumor.

151. The bispecific chimeric antigen receptor of any one of embodiments 148-150, wherein the first antigen is CD19, and the second antigen is a tumor associated MUC1.

152. The bispecific chimeric antigen receptor of any one of embodiments 148-151, wherein the first antigen binding domain comprises one of the amino acid sequences of SEQ ID: 5 and 6.

153. The modified T cell of any one of embodiments 138-147, wherein the second antigen binding domain comprises one of the amino acid sequence of SEQ ID: 70-72 and 79-81.

154. A method of enhancing T cell response in a subject or treating a tumor of the subject, the method comprising: administering an effective amount of modified T cell of any one of embodiments 138-147 to the subject to provide a T-cell response such that the CAR T cell is expanded in the blood of the subject via cells expressing CD19.

155. The modified T cells of any one of embodiments 138-147, wherein the tumor associated MUC1 are expressed on tumor cells and not on corresponding non-malignant cells.

156. The modified T cells of any one of embodiments 138-147, wherein a scFv against the tumor associated MUC1 directly interacts with an o-glycosylated GSTA motif (SEQ ID NO. 88).

157. A cell comprising the bispecific CAR of any one of embodiments 148-152.

158. A nucleic acid encoding the bispecific CAR of any one of embodiments 148-152.

159. A T cell comprising a first CAR and a second CAR, wherein an antigen binding domain of the first CAR binds an antigen selected from the group consisting of CD19, CD33, CD14, and BCMA, and an antigen binding domain of the second CAR binds a tumor associated MUC1.

160. The T cell of embodiment 159, wherein the first CAR comprises the amino acid sequence of SEQ ID NO: 207, and the second CAR comprises the amino acid sequence of SEQ ID: 202.

161. The T cell of embodiment 159, wherein the first CAR comprises the amino acid sequence of SEQ ID NO: 203, 207, 216, or 219, and the second CAR comprises the amino acid sequence of SEQ ID: 202 or 205.

162. The T cell of embodiment 159, wherein the antigen binding domain of the second CAR comprises the amino acid sequence of SEQ ID NO: 70.

163. The T cell of embodiment 159, wherein the antigen binding domain of the second CAR comprises the amino acid sequence of SEQ ID NO: 5 or 6.

164. The T cell of embodiment 159, wherein the Isolated T cell comprises one of the nucleic acid sequences of SEQ ID NO: 201, 204, 206, 208, 215, 217, 218, and 220.

165. The T cell of any one of embodiments 159-164, wherein each of the first CAR and the second CAR comprises an antigen binding domain, a transmembrane domain, and a cytoplasmic domain.

166. The T cell of embodiment 165, wherein the cytoplasmic domain comprises a co-stimulatory domain and a CD3 zeta domain.

167. The T cell of embodiment 166, wherein the co-stimulatory domain comprises the intracellular domain of CD27, CD28, 4-1BB, OX40, CD30, CD40, PD-1, ICOS, lymphocyte function-associated antigen-1 (LFA-1), CD2, CD7, LIGHT, NKG2C, B7-H3, a ligand that specifically binds with CD83, or a combination thereof.

168. The T cell of embodiment 159, wherein the T cell comprises a dominant negative variant of a receptor of programmed death 1 (PD-1), cytotoxic T lymphocyte antigen-4 (CTLA-4), B- and T-lymphocyte attenuator (BTLA), T cell immunoglobulin mucin-3 (TIM-3), lymphocyte-activation protein 3 (LAG-3), T cell immunoreceptor with Ig and ITIM domains (TIGIT), leukocyte-associated immunoglobulin-like receptor 1 (LAIRl), natural killer cell receptor 2B4 (2B4), or CD 160.

169. The T cell of embodiment 159, wherein the T cell comprises a reduced amount of TCR, as compared to the corresponding wide-type T cell.

170. A composition comprising a population of the T cell of any one of embodiments 159-169. 171. A method of enhancing T cell response in a subject or treating a tumor of the subject, the method comprising: administering an effective amount of the T cell of any one of embodiments 159-169.

172. The nucleic acid, the vector, the cell (including T cell and modified T cell), the bispecific CAR, the composition, or the method of any one of embodiments 1-171, wherein the tumor antigen, is a solid tumor antigen.

173. The nucleic acid, the vector, the cell (including T cell and modified T cell), the bispecific CAR, the composition, or the method of any one of embodiments 1-172, wherein the solid tumor antigen is tMUC 1, PRLR, CLCA1, MUC12, GUCY2C, GPR35, CR1L, MUC 17, TMPRSS11B, MUC21, TMPRSS11E, CD207, SLC30A8, CFC1, SLC12A3, SSTR1, GPR27, FZD10, TSHR, SIGLEC15, SLC6A3, KISS1R, QRFPR, GPR119, CLDN6, UPK2, ADAM12, SLC45A3, ACPP, MUC21, MUC16, MS4A12, ALPP, CEA, EphA2, FAP, GPC3, IL13-Ra2, Mesothelin, PSMA, ROR1, VEGFR-II, GD2, FR-α, ErbB2, EpCAM, EGFRvIII, or EGFR, and wherein the B cell antigen is CD19, CD20, CD22, or BCMA.

174. A method for enhancing T cell expansion and/or cytokine release (e.g., IL-6 and INF-γ) in a subject having cancer, the method comprising: providing a plurality of nucleic acids into T cells, the plurality of nucleic acids encoding a chimeric antigen receptor (CAR) binding a solid tumor antigen and encoding a CAR binding a B cell antigen; and administering an effective amount of the T cells to the subject.

175. A method for enhancing T cell response and/or cytokine release (e.g., IL-6 and INF-γ) in a subject having cancer, the method comprising: providing a plurality of nucleic acids into T cells, the plurality of nucleic acids encoding a chimeric antigen receptor (CAR) binding a solid tumor antigen, a CAR binding a B cell antigen, and a modified PD-1 lacking a functional PD-1 intracellular domain; and administering an effective amount of the T cells to the subject.

176. A modified cell comprising a plurality of nucleic acids encoding a chimeric antigen receptor (CAR) binding a solid tumor antigen associated with tumor of a subject, a CAR binding a B cell antigen, and a modified PD-1 lacking a functional PD-1 intracellular domain.

177. The modified cell or the method of embodiments of 175 or 176, wherein the subject has a higher level of T cell expansion and a higher amount of memory T cells as compared with a subject that is administered an effective amount of the CAR T cells that do not have the CAR binding the B cell antigen nor the modified PD-1.

178. The modified cell or the method of embodiments of 175 or 176, wherein the modified PD-1 comprises one of the amino acid sequences of SEQ ID NO: 89-95.

179. The modified cell or the method of embodiments of any one of embodiments 174-178, wherein the solid tumor antigen is tMUC 1, PRLR, CLCA1, MUC12, GUCY2C, GPR35, CR1L, MUC 17, TMPRSS11B, MUC21, TMPRSS11E, CD207, SLC30A8, CFC1, SLC12A3, SSTR1, GPR27, FZD10, TSHR, SIGLEC15, SLC6A3, KISS1R, QRFPR, GPR119, CLDN6, UPK2, ADAM12, SLC45A3, ACPP, MUC21, MUC16, MS4A12, ALPP, CEA, EphA2, FAP, GPC3, IL13-Ra2, Mesothelin, PSMA, ROR1, VEGFR-II, GD2, FR-α, ErbB2, EpCAM, EGFRvIII, or EGFR, and the B cell antigen is CD19, CD20, CD22, B7-H3, or BCMA.

180. The modified cell or the method of embodiments of any one of embodiments 174-178, wherein the B cell antigen comprises CD19.

181. The modified cell or the method of embodiment 180, wherein the solid tumor antigen comprises tumor associated MUC1.

182. The modified cell or the method of embodiment 181, wherein a binding domain of the CAR binding the B cell antigen comprises an amino acid sequence of SEQ ID NO: 5 or 6, and a binding domain of the CAR binding the solid tumor antigen comprises an amino acid sequence of SEQ ID NO: 70.

183. The modified cell or the method of embodiment 181, wherein the CAR binding the B cell antigen comprises an amino acid sequence of SEQ ID NO: 207, and the CAR binding the solid tumor antigen comprises an amino acid sequence of SEQ ID NO: 202.

184. The modified cell or the method of embodiment 181, wherein the CAR binding the B cell antigen comprises an antigen binding domain, a transmembrane domain, a cytoplasmic domain, and the CAR binding the solid tumor antigen comprises an antigen binding domain, a transmembrane domain, and a cytoplasmic domain.

185. The modified cell or the method of embodiment 184, wherein the cytoplasmic domain of the CAR comprises a co-stimulatory domain or a CD3 zeta domain, or a combination thereof. 186. The modified cell or the method of embodiment 180, wherein the T cell expansion is greater than a T cell expansion obtained by administering T cells having the CAR binding the solid tumor antigen in the absence of the CAR binding the B cell antigen.

187. The modified cell or the method of embodiment 186, wherein the T cell expansion is measured based on an increase in copy number of CAR molecules in genomic DNA of the T cells.

188. The modified cell or the method of embodiment 180, wherein at least one of the nucleic acids comprises a nucleic acid sequence of SEQ ID NO: 201.

189. The modified cell or the method of embodiment 178, wherein the B cell antigen comprises CD19, CD20, CD22, or BCMA.

190. The modified cell or the method of embodiment 188, wherein the solid tumor antigen comprises B7, CAIX, CD123, CD133, CD171, CD171/L1-CAM, CEA, Claudin 18.2, cMet, CS1, CSPG4, Dectin1, EGFR, EGFR vIII, EphA2, ERBB receptors, ErbB T4, ERBB2, FAP, Folate receptor 1, FITC, Folate receptor 1, FSH, GD2, GPC3, HA-1 H/HLA-A2, HER2, IL-11Ra, IL13 receptor a2, IL13R, IL13Ra2 (zetakine), Kappa, Leukemia, LewisY, Mesothelin, MUC1, NKG2D, NY-ESO-1, PSMA, ROR-1, TRAIL-receptor1, B7-H3, or VEGFR2.

191. The modified cell or the method of embodiment 178, wherein the CAR binding the B cell antigen comprises an amino acid sequence of SEQ ID NO: 203, 207, 216, or 219.

192. The modified cell or the method of embodiment 178, wherein the CAR binding the solid tumor antigen comprises an amino acid sequence of SEQ ID NO: 202 or 205.

193. The modified cell or the method of embodiment 178, wherein at least one of nucleic acids comprises a nucleic acid sequence of SEQ ID NO: 201, 204, 206, 208, 215, 217, 218, or 220.

194. A method for increasing a number or ratio of an immune cell subpopulation and/or increasing or extending persistence of the immune cell subpopulation in a subject having cancer, the method comprising: administering an effective amount of a composition comprising T-cells to the subject, the T-cells including a chimeric antigen receptor (CAR) and a modified PD-1, the modified PD-1 lacking a functional PD-1 intracellular domain; and monitoring T-cell response in the subject, the immune cell subpopulation comprising naive T-cells, stem cell memory T-cells, and/or central memory T-cells, wherein the number or ratio of the immune cell subpopulation in the subject is increased as compared to corresponding T-cells that do not include the modified PD-1; or monitoring the persistence of the immune cell subpopulation in the subject, whether it is increased or extended as compared to the corresponding T-cells that do not include the modified PD-1.

195. The method of embodiment 194, wherein monitoring the T-cell response in the subject comprises at least one of: detecting mRNA of the modified PD-1; detecting a number of one or more white blood cells; detecting a number of at least one of naive T-cells, stem cell memory T-cells, and central memory T-cells; detecting a CAR copy number; detecting CD3 positive cell number; detecting a number of T-cells expressing CAR; and detecting a level of one or more cytokines.

196. The method of embodiment 194, wherein the T-cells has more memory T-cells in the subject than those of T-cells that are introduced with the CAR and do not include the modified PD-1.

197. The method of embodiment 194, wherein the modified PD-1 comprises one sequences of SEQ ID: 89-93 or the modified PD-1 do not include SEQ ID: 94 or 95.

198. The method of embodiment 194, wherein the T-cells comprise a dominant negative variant of PD-1, and endogenous gene of PD-1 of the T cells is not disrupted.

199. The method of embodiment 194, wherein the CAR comprises an extracellular domain, a transmembrane domain, and an intracellular domain, the extracellular domain binds an antigen. 200. The method of embodiment 199, wherein the intracellular domain comprises a co-stimulatory domain that comprises an intracellular domain of a costimulatory molecule selected from the group consisting of CD27, CD28, 4-1BB, OX40, CD30, CD40, PD-1, ICOS, lymphocyte function-associated antigen-1 (LFA-1), CD2, CD7, LIGHT, NKG2C, B7-H3, and any combination thereof.

201. The method of embodiment 199, wherein the antigen is Epidermal growth factor receptor (EGFR), Variant Ill of the epidermal growth factor receptor (EGFRvIII), Human epidermal growth factor receptor 2 (HER2), Mesothelin (MSLN), Prostate-specific membrane antigen (PSMA), Carcinoembryonic antigen (CEA), Disialoganglioside 2 (GD2), Interleukin-13Ra2 (IL13Ra2), Glypican-3 (GPC3), Carbonic anhydrase IX (CAIX), L1 cell adhesion molecule (L1-CAM), Cancer antigen 125 (CA125), Cluster of differentiation 133 (CD133), Fibroblast activation protein (FAP), Cancer/testis antigen 1B (CTAG1B), Mucin 1 (MUC1), Folate receptor-α (FR-α), CD19, FZD10, TSHR, PRLR, Muc 17, GUCY2C, CD207, CD3, CD5, B-Cell Maturation Antigen (BCMA), or CD4.

202. The method of embodiment 194, wherein the T-cells comprise a CAR binding a solid tumor antigen and a CAR binding a white cell antigen.

203. The method of embodiment 202, wherein the the solid tumor antigen is tMUC 1, PRLR, CLCA1, MUC12, GUCY2C, GPR35, CR1L, MUC 17, TMPRSS11B, MUC21, TMPRSS11E, CD207, SLC30A8, CFC1, SLC12A3, SSTR1, GPR27, FZD10, TSHR, SIGLEC15, SLC6A3, KISS1R, QRFPR, GPR119, CLDN6, UPK2, ADAM12, SLC45A3, ACPP, MUC21, MUC16, MS4A12, ALPP, CEA, EphA2, FAP, GPC3, IL13-Ra2, Mesothelin, PSMA, ROR1, VEGFR-II, GD2, FR-α, ErbB2, EpCAM, EGFRvIII, or EGFR, and the B cell antigen is CD19, CD20, CD22, B7-H3, or BCMA.

204. The method of embodiment 202, wherein the white cell antigen is a B cell antigen.

205. The method of embodiment 202, wherein the B cell antigen is CD19, CD20, CD22, or BCMA.

206. A method for increasing a number or ratio of an immune cell subpopulation and/or increasing or extending persistence of the immune cell subpopulation, the method comprising: providing T-cells with a nucleic acid sequence encoding a chimeric antigen receptor (CAR); and providing T-cells with a nucleic acid sequence encoding a modified PD-1, the modified PD-1 lacking a functional PD-1 intracellular domain, the immune cell subpopulation comprising naive T-cells, stem cell memory T-cells, and/or central memory T-cells, wherein the number or ratio of the immune cell subpopulation is increased as compared to corresponding T-cells that do not include the modified PD-1; or monitoring the persistence of the immune cell subpopulation, whether it is increased or extended as compared to the corresponding T-cells that do not include the modified PD-1.

207. An isolated zinc finger nuclease (ZFN) comprising: a first zinc finger protein (ZFP) binding to a first target site in a CTLA4 gene, the first ZFP comprising three or more zinc finger domains; a second ZFP binding to a second target site in the CTLA4 gene, the second ZFP comprising three or more zinc finger domains; and a cleavage domain, wherein the first ZFP comprises amino acid sequences SEQ ID NOS.: 301, 302, and 303 ordered from a N-terminal of the first ZFP to a C-terminal of the first ZFP, and the second ZFP comprises amino acid sequences SEQ ID NOS.: 305, 306, and 307 ordered from a N-terminal of the second ZFP to a C-terminal of the second ZFP.

208. An isolated ZFN that binds a target site in a CTLA4 gene, the target site comprising a nucleotide sequence SEQ ID NO.: 304.

209. An isolated zinc finger nuclease (ZFN) comprising: a first zinc finger protein (ZFP) binding to a first target site in a LAG3 gene, the first ZFP comprising three or more zinc finger domains; a second ZFP binding to a second target site in the LAG3 gene, the second ZFP comprising three or more zinc finger domains; and a cleavage domain, wherein: the first ZFP comprises amino acid sequences SEQ ID NOS.: 308, 309, and 310 ordered from a N-terminal of the first ZFP to a C-terminal of the first ZFP, and the second ZFP comprises amino acid sequences SEQ ID NOS.: 309, 308, and 312 ordered from a N-terminal of the second ZFP to a C-terminal of the second ZFP, or the first ZFP comprises amino acid sequences SEQ ID NOS.: 313, 314, and 315 ordered from a N-terminal of the first ZFP to a C-terminal of the first ZFP, and the second ZFP comprises amino acid sequences SEQ ID NOS.: 316, 317, and 318 ordered from a N-terminal of the second ZFP to a C-terminal of the second ZFP.

210. An isolated ZFN that binds a target site in a LAG3 gene, the target site comprising a nucleotide sequence SEQ ID NO.: 311 or 319.

211. An isolated zinc finger nuclease (ZFN) comprising: a first zinc finger protein (ZFP) binding to a first target site in a BTLA gene, the first ZFP comprising three or more zinc finger domains; a second ZFP binding to a second target site in the BTLA gene, the second ZFP comprising three or more zinc finger domains; and a cleavage domain, wherein the first ZFP comprises amino acid sequences SEQ ID NOS.: 320, 321, and 322 ordered from a N-terminal of the first ZFP to a C-terminal of the first ZFP, and the second ZFP comprises amino acid sequences SEQ ID NOS.: 323, 324, and 325 ordered from a N-terminal of the second ZFP to a C-terminal of the second ZFP.

212. An isolated ZFN that binds a target site in a BTLA gene, the target site comprising a nucleotide sequence SEQ ID NO.: 326.

213. An isolated zinc finger nuclease (ZFN) comprising: a first zinc finger protein (ZFP) binding to a first target site in a TIM3 gene, the first ZFP comprising three or more zinc finger domains; a second ZFP binding to a second target site in the TIM3 gene, the second ZFP comprising three or more zinc finger domains; and a cleavage domain, wherein: the first ZFP comprises amino acid sequences SEQ ID NOS.: 327, 328, and 329 ordered from a N-terminal of the first ZFP to a C-terminal of the first ZFP, and the second ZFP comprises amino acid sequences SEQ ID NOS.: 330, 331, and 332 ordered from a N-terminal of the second ZFP to a C-terminal of the second ZFP; or the first ZFP comprises amino acid sequences SEQ ID NOS.: 334, 335, and 336 ordered from a N-terminal of the first ZFP to a C-terminal of the first ZFP, and the second ZFP comprises amino acid sequences SEQ ID NOS.: 337, 338, and 339 ordered from a N-terminal of the second ZFP to a C-terminal of the second ZFP.

214. An isolated ZFN that binds a target site in a TIM3 gene, the target site comprising a nucleotide sequence SEQ ID NO.: 333 or 340.

215. An isolated zinc finger nuclease (ZFN) comprising: a first zinc finger protein (ZFP) binding to a first target site in a FOXP3 gene, the first ZFP comprising three or more zinc finger domains; a second ZFP binding to a second target site in the FOXP3 gene, the second ZFP comprising three or more zinc finger domains; and a cleavage domain, wherein: the first ZFP comprises amino acid sequences SEQ ID NOS.: 341, 328, and 342 ordered from a N-terminal of the first ZFP to a C-terminal of the first ZFP, and the second ZFP comprises amino acid sequences SEQ ID NOS.: 343, 344, and 345 ordered from a N-terminal of the second ZFP to a C-terminal of the second ZFP, the first ZFP comprises amino acid sequences SEQ ID NOS.: 347, 348, and 349 ordered from a N-terminal of the first ZFP to a C-terminal of the first ZFP, and the second ZFP comprises amino acid sequences SEQ ID NOS.: 350, 344, and 351 ordered from a N-terminal of the second ZFP to a C-terminal of the second ZFP; or the first ZFP comprises amino acid sequences SEQ ID NOS.: 288, 310, and 314 ordered from a N-terminal of the first ZFP to a C-terminal of the first ZFP, and the second ZFP comprises amino acid sequences SEQ ID NOS.: 308, 308, and 284 ordered from a N-terminal of the second ZFP to a C-terminal of the second ZFP.

216. An isolated ZFN that binds a target site in a FOXP3 gene, the target site comprising a nucleotide sequence SEQ ID NO.: 346, 352, or 283.

217. An isolated zinc finger nuclease (ZFN) comprising: a first zinc finger protein (ZFP) binding to a first target site in a SIVA1 gene, the first ZFP comprising three or more zinc finger domains; a second ZFP binding to a second target site in the SIVA1 gene, the second ZFP comprising three or more zinc finger domains; and a cleavage domain, wherein: the first ZFP comprises amino acid sequences SEQ ID NOS.: 353, 331, and 354 ordered from a N-terminal of the first ZFP to a C-terminal of the first ZFP, and the second ZFP comprises amino acid sequences SEQ ID NOS.: 355, 300, and 299 ordered from a N-terminal of the second ZFP to a C-terminal of the second ZFP; or the first ZFP comprises amino acid sequences SEQ ID NOS.: 308, 314, and 312 ordered from a N-terminal of the first ZFP to a C-terminal of the first ZFP, and the second ZFP comprises amino acid sequences SEQ ID NOS.: 288, 287, and 286 ordered from a N-terminal of the second ZFP to a C-terminal of the second ZFP.

218. An isolated ZFN that binds a target site in a SIVA1 gene, the target site comprising a nucleotide sequence SEQ ID NO.: 296 or 285.

219. An isolated zinc finger nuclease (ZFN) comprising: a first zinc finger protein (ZFP) binding a first target site in a LGALS9 gene, the first ZFP comprising three or more zinc finger domains; a second ZFP binding to a second target site in the LGALS9 gene, the second ZFP comprising three or more zinc finger domains; and a cleavage domain, wherein the first ZFP comprises amino acid sequences SEQ ID NOS.: 298, 324, and 297 ordered from a N-terminal of the first ZFP to a C-terminal of the first ZFP, and the second ZFP comprises amino acid sequences SEQ ID NOS.: 295, 300, and 294 ordered from a N-terminal of the second ZFP to a C-terminal of the second ZFP.

220. An isolated ZFN that binds a target site in a CD33 gene, the target site comprising a nucleotide sequence SEQ ID NO.: 293.

221. An isolated zinc finger nuclease (ZFN) comprising: a first zinc finger protein (ZFP) binding to a first target site in a CD33 gene, the first ZFP comprising three or more zinc finger domains; a second ZFP binding to a second target site in the CD33 gene, the second ZFP comprising three or more zinc finger domains; and a cleavage domain, wherein the first ZFP comprises amino acid sequences SEQ ID NOS.: 301, 292, and 312 ordered from a N-terminal of the first ZFP to a C-terminal of the first ZFP, and the second ZFP comprises amino acid sequences SEQ ID NOS.: 291, 290, and 310 ordered from a N-terminal of the second ZFP to a C-terminal of the second ZFP.

222. An isolated ZFN that binds a target site in a LGALS9 gene, the target site comprising a nucleotide sequence SEQ ID NO.: 289.

223. The isolated ZFN of any one of embodiments 207-222, wherein the gene is a human gene.

224. The isolated ZFN of any one of embodiments 207-222, wherein the cleavage domain comprises a wild-type or engineered FokI cleavage domain.

225. A polynucleotide encoding the isolated ZFN of any one of embodiments 207-222. 226. A vector comprising the polynucleotide of embodiment 225.

227. The vector of embodiment 226, wherein the vector is an adenoviral or lentiviral vector.

228. An isolated cell or a cell line comprising the isolated ZFN of any one of embodiments 207-222.

229. The isolated cell or the cell line of embodiment 228, wherein the isolated cell is a stem cell, a T cell or a Natural Killer (NK) cell.

230. The isolated cell or the cell line of embodiment 228, wherein the cell is a T cell derived from a primary human T cell isolated from a human donor.

231. The isolated cell or the cell line of embodiment 228, wherein the cell has a reduced expression of an endogenous gene of CTLA4, LAG3, BTLA, TIM3, FOXP3, SIVA1, and LGALS9.

232. An isolated cell comprising isolated nucleic acid sequence encoding a chimeric antigen receptor (CAR), wherein an endogenous gene is inactivated using the ZFN of any one of embodiments 207-222.

233. The isolated cell or the cell line of embodiment 232, wherein the CAR comprises an antigen binding domain, a transmembrane domain, a co-stimulatory domain, and a CD3 zeta signaling domain.

234. The isolated cell or the cell line of embodiment 233, wherein the cell has a reduced graft-versus-host disease (GVHD) response in a bioincompatible human recipient as compared to the GVHD response of the primary human T cell.

235. The isolated cell or the cell line of embodiment 232, wherein an antigen binding domain of the CAR binds FZD10, TSHR, PRLR, Muc17, GUCY2C, CD207, CD19, or CD20.

236. The isolated cell or the cell line of embodiment 232, wherein a co-stimulatory domain of the CAR comprises the intracellular domain of a costimulatory molecule selected from the group consisting of CD27, CD28, 4-1BB, OX40, CD30, CD40, PD-1, ICOS, lymphocyte function-associated antigen-1 (LFA-1), CD2, CD7, LIGHT, NKG2C, B7-H3, and any combination thereof.

237. The isolated cell or the cell line of embodiment 228, wherein the isolated cell or the cell line is a T cell comprising a nucleic acid sequence encoding hTERT or a nucleic acid encoding SV40LT, or a combination thereof.

238. The isolated cell or the cell line of embodiment 237, wherein the T cell comprises a nucleic acid sequence encoding hTERT and a nucleic acid encoding SV40LT.

239. The isolated cell or the cell line of embodiment 237, wherein expression of hTERT is regulated by an inducible expression system.

240. The isolated cell or the cell line of embodiment 237, wherein expression of SV40LT gene is regulated by an inducible expression system.

241. The isolated cell or the cell line of embodiment 240, wherein the inducible expression system is rTTA-TRE, which increases or activates the expression of SV40LT gene or hTERT gene, or a combination thereof.

242. The isolated cell or the cell line of embodiment 237, wherein the T cell comprises a nucleic acid sequence encoding a suicide gene, and/or the suicide gene comprises a HSV-TK suicide gene system.

243. A method of treating cancer in a subject, the method comprising administering a genetically modified cell of embodiment 232 to the subject, wherein the cancer is selected from the group consisting of a lung carcinoma, pancreatic cancer, liver cancer, bone cancer, breast cancer, colorectal cancer, leukemia, ovarian cancer, lymphoma, and brain cancer.

244. An isolated zinc finger nuclease (ZFN) comprising: a first zinc finger protein (ZFP) binding to a first target site in a B2M gene, the first ZFP comprising three or more zinc finger domains; a second ZFP binding to a second target site in the B2M gene, the second ZFP comprising three or more zinc finger domains; and a cleavage domain.

245. An isolated ZFN that binds a target site in a B2M gene, the target site comprising a nucleotide sequence.

246. An isolated zinc finger nuclease (ZFN) comprising: a first zinc finger protein (ZFP) binding to a first target site in a CIITA gene, the first ZFP comprising three or more zinc finger domains; a second ZFP binding to a second target site in the CIITA gene, the second ZFP comprising three or more zinc finger domains; and a cleavage domain.

247. The isolated ZFN of any one of embodiments 244-246, wherein the gene is a human gene.

248. The isolated ZFN of any one of embodiments 244-246, wherein the cleavage domain comprises a wild-type or engineered FokI cleavage domain.

249. A polynucleotide encoding the isolated ZFN of any one of embodiments 244-248.

250. A vector comprising the polynucleotide of embodiments 249.

251. The vector of embodiments 250, wherein the vector is an adenoviral or lentiviral vector.

252. An isolated cell or a cell line comprising the isolated ZFN of any one of embodiments 244-248.

253. The isolated cell or the cell line of embodiments 252, wherein the isolated cell is a stem cell, a T cell or a Natural Killer (NK) cell.

254. The isolated cell or the cell line of embodiments 253, wherein the cell is a T cell derived from a primary human T cell isolated from a human donor.

255. The isolated cell or the cell line of embodiments 254, wherein the cell has a reduced expression of an endogenous gene of B2M or CIITA.

256. An isolated cell comprising isolated nucleic acid sequence encoding a chimeric antigen receptor (CAR), wherein an endogenous gene of the CAR is inactivated using the ZFN of any one of embodiments 244-256.

257. The isolated cell or the cell line of embodiments 256, wherein the CAR comprises an antigen binding domain, a transmembrane domain, a co-stimulatory domain, and a CD3 zeta signaling domain.

258. The isolated cell or the cell line of embodiments 257, wherein the cell has a reduced host-versus-graft disease (HVGD) response in a bioincompatible human recipient as compared to the HVGD response of the primary human T cell.

259. The isolated cell or the cell line of embodiments 258, wherein an antigen binding domain of the CAR binds FZD10, TSHR, PRLR, Muc17, GUCY2C, CD207, CD19, or CD20.

260. The isolated cell or the cell line of embodiments 258, wherein a co-stimulatory domain of the CAR comprises the intracellular domain of a costimulatory molecule selected from the group consisting of CD27, CD28, 4-1BB, OX40, CD30, CD40, PD-1, ICOS, lymphocyte function-associated antigen-1 (LFA-1), CD2, CD7, LIGHT, NKG2C, B7-H3, and any combination thereof.

261. The isolated cell or the cell line of embodiments 260, wherein the isolated cell or the cell line is a T cell comprising a nucleic acid sequence encoding hTERT or a nucleic acid encoding SV40LT, or a combination thereof.

262. The isolated cell or the cell line of embodiments 261, wherein the T cell comprises a nucleic acid sequence encoding hTERT and a nucleic acid encoding SV40LT.

263. The isolated cell or the cell line of embodiments 262, wherein expression of hTERT is regulated by an inducible expression system.

264. The isolated cell or the cell line of embodiments 262, wherein expression of SV40LT gene is regulated by an inducible expression system.

265. The isolated cell or the cell line of embodiments 264, wherein the inducible expression system is rTTA-TRE, which increases or activates the expression of SV40LT gene or hTERT gene, or a combination thereof.

266. The isolated cell or the cell line of embodiment 262, wherein the T cell comprises a nucleic acid sequence encoding a suicide gene, and/or the suicide gene comprises a HSV-TK suicide gene system.

267. A method of treating cancer in a subject, the method comprising administering a genetically modified cell of embodiment 25 to the subject, wherein the cancer is selected from the group consisting of lung carcinoma, pancreatic cancer, liver cancer, bone cancer, breast cancer, colorectal cancer, leukemia, ovarian cancer, lymphoma, and brain cancer.

268. A modified cell comprising a reduced amount of Major Histcompatibility Complex II (MHC II) as compared to a corresponding wild-type cell, wherein the modified cell has decreased immunogenicity as compared to the corresponding wild-type cell.

269. A method for generating modified cells for transplantation, comprising culturing in a culture media modified cells that have a reduced amount of Major Histcompatibility Complex II (MHC II) as compared to corresponding wild-type cells, wherein the modified cells have decreased immunogenicity as compared to the corresponding wild-type cells.

270. A method for treating a condition, comprising administering to a subject a therapeutically effective amount of modified cells that have a reduced amount of Major Histcompatibility Complex II (MHC II) as compared to corresponding wild-type cells, wherein the modified cells have decreased immunogenicity as compared to the corresponding wild-type cells.

271. The modified cell of any one of embodiments 268-270, wherein the modified cell has reduced expression of one or more genes of a biosynthesis or transportation pathway of MHC II as compared to the corresponding wild-type cell.

272. The modified cell of any one of embodiments 268-270, wherein the modified cell accumulates a reduced amount of MHC II on the modified cell as compared to the corresponding wild-type cell.

273. The modified cell of any one of embodiments 268-270, wherein the modified cell has a disruption in an endogenous gene associated with a biosynthesis or transportation pathway of MHC II.

274. The modified cell of any one of embodiments 268-270, wherein the disruption comprises a disruption of MHC class II transactivator (CIITA).

275. The modified cell of any one of embodiments 268-270, wherein the disruption results from deletion of at least a portion of CIITA.

276. The modified cell of any one of embodiments 268-270 the MHC II comprises Human Leukocyte antigen II (HLA II).

277. The modified cell of any one of embodiments 268-270, wherein the decreased immunogenicity comprises a deceased level of inflammatory responses induced by the modified cell as compared to the corresponding wild-type cell.

278. A modified cell comprising a reduced amount of Major Histcompatibility Complex I (MHC I) as compared to a corresponding wild-type cell, wherein the modified cell has decreased immunogenicity as compared to the corresponding wild-type cell.

279. The modified cell of embodiment 278, wherein the modified cell has a disruption in an endogenous gene associated with a biosynthesis or transportation pathway of MHC I.

280. The modified cell of embodiment 279, wherein the disruption comprises a disruption of one or more exons of Transporter associated with antigen presentation 1 (TAP1) gene or a disruption of one or more exons of TAP-associated glycoprotein (TAPBP) gene.

281. The modified cell of embodiment 280, wherein the disruption of the one or more exons of TAP1 gene comprises a disruption of an exon of TAP1 gene.

282. The modified cell of embodiment 280, wherein the disruption of TAPBP gene comprises a heterozygous disruption of TAP1 gene, and the modified cell expresses a wild-type TAPBP gene.

283. The modified cell of embodiment 280, wherein the disruption of the one or more exons of TAPBP gene comprises a disruption of an exon of TAPBP gene.

284. The modified cell of embodiment 280, wherein the decreased immunogenicity comprises a decreased level of inflammatory responses induced by the modified cell as compared to the corresponding wild-type cell.

285. The modified cell of embodiment 280, wherein a karyotype of the modified cell is the same as a karyotype of the corresponding wild-type cell.

286. The modified cell of embodiment 280, wherein a level of pluripotency of the modified cell is substantially the same as a level of pluripotency of the corresponding wild-type cell.

287. The modified cell of any one of embodiments 268-286, wherein the cell is a T cell or a NK cell.

288. The modified cell of any one of embodiments 268-286, wherein the modified cell comprises a CAR.

289. The modified cell of embodiment 288, wherein the CAR comprises an extracellular domain, a transmembrane domain, and an intracellular domain, and the extracellular domain binds a tumor antigen.

290. The modified cell of embodiment 289, wherein the tumor antigen includes HER2, CD19, CD20, CD22, Kappa or light chain, CD30, CD33, CD123, CD38, ROR1, ErbB3/4, EGFR, EGFRvIII, EphA2, FAP, carcinoembryonic antigen, EGP2, EGP40, mesothelin, TAG72, PSMA, NKG2D ligands, B7-H6, IL-13 receptor a 2, IL-11 receptor a, MUC1, MUC16, CA9, GD2, GD3, HMW-MAA, CD171, Lewis Y, G250/CAIX, HLA-AI MAGE A1, HLA-A2 NY-ESO-1, PSC1, folate receptor-α, CD44v7/8, 8H9, NCAM, VEGF receptors, 5T4, Fetal AchR, NKG2D ligands, CD44v6, TEM1, or TEM8.

291. The modified cell of embodiment 289, wherein the intracellular domain comprising a co-stimulatory domain that comprises an intracellular domain of a costimulatory molecule selected from the group consisting of CD27, CD28, 4-1BB, OX40, CD30, CD40, PD-1, ICOS, lymphocyte function-associated antigen-1 (LFA-1), CD2, CD7, LIGHT, NKG2C, B7-H3, and any combination thereof.

292. The modified cell of embodiment 289, wherein the intracellular domain comprises a CD3 zeta signaling domain.

293. A method for improving infusion of cells or cells derived from the cells, the method comprising: culturing in a culture media the modified cells of the embodiments 246; and administering a subject a composition comprising the modified cells, wherein immune responses of the subject in response to the infusion is less than infusion using wild type cells.

294. The method of embodiments 293, wherein the infusion is an allogeneic infusion.

295. A modified human T cell comprising: a nucleic acid sequence encoding a CAR; a disruption of TCR gene; a disruption of MHC class II transactivator (CIITA) gene; and a disruption of Transporter associated with antigen presentation 1 (TAP1) gene or a disruption of TAP-associated glycoprotein (TAPBP) gene, wherein the modified human T cell has: a reduced amount of TCR, a reduced amount of MHC I, or a reduced amount of MHC II, as compared to human T cells without the disruption; or a reduced host-versus-graft disease (HVGD) response in a bioincompatible human recipient as compared to the HVGD response of the primary human T cell.

296. The modified cell of embodiments 295, wherein the CAR comprises an extracellular domain, a transmembrane domain, and an intracellular domain, and the extracellular domain binds a tumor antigen.

297. The modified cell of embodiments 296, wherein the tumor antigen includes HER2, CD19, CD20, CD22, Kappa or light chain, CD30, CD33, CD123, CD38, ROR1, ErbB3/4, EGFR, EGFRvIII, EphA2, FAP, carcinoembryonic antigen, EGP2, EGP40, mesothelin, TAG72, PSMA, NKG2D ligands, B7-H6, IL-13 receptor a 2, IL-11 receptor a, MUC1, MUC16, CA9, GD2, GD3, HMW-MAA, CD171, Lewis Y, G250/CAIX, HLA-AI MAGE A1, HLA-A2 NY-ESO-1, PSC1, folate receptor-α, CD44v7/8, 8H9, NCAM, VEGF receptors, 5T4, Fetal AchR, NKG2D ligands, CD44v6, TEM1, or TEM8.

298. The modified cell of embodiments 296, wherein the intracellular domain comprises a co-stimulatory domain that comprises an intracellular domain of a costimulatory molecule selected from the group consisting of CD27, CD28, 4-1BB, OX40, CD30, CD40, PD-1, ICOS, lymphocyte function-associated antigen-1 (LFA-1), CD2, CD7, LIGHT, NKG2C, B7-H3, and any combination thereof.

299. The modified cell of embodiments 296, wherein the intracellular domain comprises a CD3 zeta signaling domain.

300. A method of modifying a target genomic locus in a lymphocyte, the method comprising: introducing into the lymphocyte a nuclease agent that make a single or double-strand break within the target genomic locus; and selecting the lymphocyte of which endogenous B2M, CIITA, TAP1, and/or TAPBP genes are disrupted.

301. A genetically modified lymphocyte comprising a nuclease agent targeting endogenous B2M, CIITA, TAP1, and/or TAPBP genes.

302. The method or the genetically modified lymphocyte of any one of embodiments 300-301, wherein the nuclease agent is a zinc finger nuclease (ZFN), a Transcription Activator-Like Effector Nuclease (TALEN), or a meganuclease.

303. The method or the genetically modified lymphocyte of any one of embodiments 300-301, wherein the nuclease agent comprises a Clustered Regularly Interspaced Short Palindromic Repeats (CRISPR)-associated (Cas) protein and a guide RNA (gRNA).

304. The method of embodiments 303, wherein the Cas protein is Cas9.

305. The method or the genetically modified lymphocyte of any one of embodiments 300-301, wherein the nuclease agent comprises: one or more ZFNs targeting one or more exons of Transporter associated with antigen presentation 1 (TAP1) gene.

306. The method or the genetically modified lymphocyte of one of embodiments 300-301, wherein the nuclease agent comprises: one or more ZFNs targeting one or more exons of Transporter associated with antigen presentation 1 (TAP1) gene or a disruption of one or more exons of TAP-associated glycoprotein (TAPBP) gene, or an exon of TAP1 gene, or the isolated ZFN of any one of embodiments 1-4.

307. The genetically modified lymphocyte or the method of any one of embodiments 300-306, wherein the lymphocyte is NK cell or T cell.

308. The genetically modified lymphocyte or the method of any one of embodiments 300-306, wherein the genetically modified cell elicits a reduced graft versus host disease response against allogeneic cells as compared to a corresponding cell that does not include nucleic acid sequence.

309. The genetically modified lymphocyte or the method of any one of embodiments 300-306, wherein the lymphocyte is a T cell derived from a primary human T cell isolated from a human donor.

310. The genetically modified lymphocyte or the method of any one of embodiments 300-306, wherein the T cell comprises a CAR.

311. The genetically modified lymphocyte or the method of embodiment 310, wherein the CAR comprises an extracellular domain, a transmembrane domain, and an intracellular domain, and the extracellular domain binds a tumor antigen.

312. The genetically modified lymphocyte or the method of embodiment 311, wherein the tumor antigen includes HER2, CD19, CD20, CD22, Kappa or light chain, CD30, CD33, CD123, CD38, ROR1, ErbB3/4, EGFR, EGFRvIII, EphA2, FAP, carcinoembryonic antigen, EGP2, EGP40, mesothelin, TAG72, PSMA, NKG2D ligands, B7-H6, IL-13 receptor a 2, IL-11 receptor a, MUC1, MUC16, CA9, GD2, GD3, HMW-MAA, CD171, Lewis Y, G250/CAIX, HLA-AI MAGE A1, HLA-A2 NY-ESO-1, PSC1, folate receptor-α, CD44v7/8, 8H9, NCAM, VEGF receptors, 5T4, Fetal AchR, NKG2D ligands, CD44v6, TEM1, or TEM8.

313. The genetically modified lymphocyte or the method of embodiment 311, wherein the intracellular domain comprising a co-stimulatory domain that comprises an intracellular domain of a costimulatory molecule selected from the group consisting of CD27, CD28, 4-1BB, OX40, CD30, CD40, PD-1, ICOS, lymphocyte function-associated antigen-1 (LFA-1), CD2, CD7, LIGHT, NKG2C, B7-H3, and any combination thereof.

314. The genetically modified lymphocyte or the method of embodiments 311, wherein the intracellular domain comprises a CD3 zeta signaling domain.

315. The genetically modified lymphocyte or the method of any one of embodiments 300-306, wherein the T cell comprises a modified T Cell Receptor (TCR).

316. The genetically modified lymphocyte or the method of 315, wherein the TCR is derived from spontaneously occurring tumor-specific T cells in patients.

317. The genetically modified lymphocyte or the method of 315, wherein the TCR binds a tumor antigen.

318. The genetically modified lymphocyte or the method of 317, wherein the tumor antigen comprises CEA, gp100, MART-1, p53, MAGE-A3, or NY-ESO-1.

319. The genetically modified lymphocyte or the method of 317, wherein the TCR comprises TCRγ and TCRσ Chains or TCRα and TCRβ chains, or a combination thereof.

320. A method of causing a T-cell response in a subject or treating a tumor of the subject, the method comprising: administering an effective amount of the T cell of any one of embodiments 301-319.

321. A method of determining the efficacy of a CAR T cell therapy, wherein the method comprises administering the nucleic acid, the cells, the composition, the modified T cell, or the bispecific CAR of any one of embodiments 1-6, 14-43, 45, and 46 to a subject in need thereof and measuring the levels of cytokine release over a period of time after introducing the CAR T cell to a subject.

322. A method of monitoring the efficacy of a CAR T cell therapy, wherein the method comprises administering the nucleic acid, the cells, or the composition of any one of embodiments 1-6 and 14-27 to a subject in need thereof and measuring the levels of cytokine release over a period of time after introducing the CAR T cell to a subject.

323. The method of embodiment 321 or 322, wherein the method further comprises comparing the level of cytokine release with control subject and wherein the control subject comprises a subject that is not introduced with CAR T cell therapy or a subject that is administered with T cells comprising a single CAR molecule (e.g., anti-solid tumor CAR).

324. The method of any one of embodiments 321-323, wherein the cytokine is IL-6, IFN-γ, or a combination thereof.

325. The method of any one of embodiments 321-324, wherein the method comprises measuring cytokine release from day 0 (one day before introducing CAR T cell therapy) today 10, to day 9, to day 8, to day 7, to day 6, to day 5, to day 4, to day 3, to day 2, or to day 1 of CAR T cell therapy.

326. The method of any one of embodiments 321-325, wherein the subject has thyroid cancer, cholangiocarcinoma, breast cancer, or pancreatic cancer.

327. The method of any one of embodiments 321-326, wherein the subject is a mammal.

328. The method of any one of embodiments 321-327, wherein the mammal is a human.

329. A method of culturing cells, enhancing cell-mediated immunity, or causing T cell response, the method comprising: collecting peripheral blood mononuclear cells (PBMCs) from a subject; obtaining target cells by mixing the PBMCs with one or more antibodies; introducing a nucleic acid sequence into the target cells; and culturing the target cells.

330. The method of embodiment 329, wherein the target T cells are T cells.

331. The method of one of embodiments 329-330, wherein the one or more antibodies are CD4 or CD8, or a combination thereof.

332. The method of one of embodiments 329-332, wherein the one or more antibodies are attached to a surface.

333. The method of embodiment 332, wherein the surface comprises a bead.

334. The method of one of embodiments 329-333, wherein the nucleic acid sequence encodes one or more CARs.

335. The method of embodiment 334, wherein the one or more CARs comprise a first CAR binding an antigen of WBC and a second CAR binding a solid tumor antigen.

336. The method of one of embodiments 329-335, wherein the cell-mediated immunity is measured using an amount of IFN-γ released in response to an antigen that the one or more CARs bind.

337. The method of embodiment 336, wherein the amount of IFN-γ released is enhanced as compared to cells transfected with the nucleic acid sequence before or without obtaining target cells mixing the PBMCs with one or more antibodies.

338. The method of one of embodiments 329-337, wherein the target cell comprises a dominant negative variant of a receptor of programmed death 1 (PD-1), cytotoxic T lymphocyte antigen-4 (CTLA-4), B- and T-lymphocyte attenuator (BTLA), T cell immunoglobulin mucin-3 (TIM-3), lymphocyte-activation protein 3 (LAG-3), T cell immunoreceptor with Ig and ITIM domains (TIGIT), leukocyte-associated immunoglobulin-like receptor 1 (LAIRI), natural killer cell receptor 2B4 (2B4), or CD 160.

339. The method of one of embodiments 329-338, wherein the target cell comprises a nucleic acid sequence encoding a suicide gene, and/or the suicide gene comprises an HSV-TK suicide gene system.

340. A method of enhancing T cell response in a subject or treating a tumor of the subject, the method comprising: administering an effective amount of modified T cell obtained using the method of one of embodiments 329-339 to the subject.

341. A composition comprising a first population of cells comprising a first CAR binding a first antigen and a second population of cells comprising a second CAR binding a second antigen, wherein the second antigen is a tumor antigen and the first antigen and second antigen are different antigens.

342. The composition of embodiment 341, wherein the first population of cells does not comprise the second CAR, and/or the second population of cells does not comprise the first CAR.

343. The composition of embodiment 342, wherein the composition further comprises a third population of cells comprising one or more nucleic acid sequences encoding the first CAR and the second CAR.

344. The composition of embodiment 341, wherein:
the second population of cells comprises the first CAR, and the first population of cells do not comprise the second CAR; or
the first population of cells comprises the second CAR.

345. The composition of embodiment 341, wherein second population of cells does not comprise the first CAR, and the first population of cells comprise the second CAR.

346. A method of enhancing expansion of the second population of cells (cells targeting solid tumor), the method comprising administering an effective amount of the composition of one of embodiments 341-345 to a subject having a form of cancer associated with or expresses the tumor antigen.

347. A method of enhancing T cell response in a subject or treating the subject having cancer, the method administering an effective amount of the composition of one of embodiments 341-345 to the subject having cancer associated with or expresses the tumor antigen.

348. A method of enhancing expansion of cells in a subject, the method comprising:
contacting cells with a first vector comprising a first nucleic acid sequence encoding the first CAR and a second vector comprising a second nucleic acid sequence encoding the second CAR to obtain the composition of one of embodiments 341-345; and
administering an effective amount of the composition to the subject having a form of cancer associated with or expresses the tumor antigen.

349. A method of enhancing T cell response in a subject or treating the subject having cancer, the method comprising:
contacting cells with a first vector comprising a first nucleic acid sequence encoding the first CAR and a second vector comprising a second nucleic acid sequence encoding the second CAR to obtain the composition of one of embodiments 341-345; and
administering an effective amount of the composition to the subject having a form of cancer associated with or expresses the tumor antigen.

350. A method of enhancing expansion of cells in a subject, the method comprising:
administering an effective amount of the first population of cells of one of embodiments 341-345; and
administering an effective amount of the second population of cells.

351. The method of one of embodiments 348-350, wherein the first vector and the second vector comprise lentiviral vectors.

352. The composition or the method of one of embodiments 341-351, wherein the first or second antigen is or comprises a surface molecule of a white blood cell (WBC), a tumor antigen, or a solid tumor antigen.

353. The composition or the method of one of embodiments 341-352, wherein the cells are modified T cells, modified NK cells, or modified dendritic cells.

354. The composition or the method of embodiment 352, wherein the WBC is a granulocyte, a monocyte, or lymphocyte.

355. The composition or the method of embodiment 354, wherein the WBC is a B cell.

356. The composition or the method of embodiment 355, wherein the cell surface molecule of the WBC is CD19, CD22, CD20, BCMA, CD5, CD7, CD2, CD16, CD56, CD30, CD14, CD68, CD11b, CD18, CD169, CD1c, CD33, CD38, CD138, or CD13.

357. The composition or the method of embodiment 354, wherein the cell surface molecule of the WBC is CD19, CD20, CD22, or BCMA.

358. The composition or the method of embodiment 354, wherein the cell surface molecule of the WBC is CD19.

359. The composition or the method of embodiment 354, wherein the tumor antigen is a solid tumor antigen.

360. The composition or the method of embodiment 354, wherein the solid tumor antigen is tMUC1, PRLR, CLCA1, MUC12, GUCY2C, GPR35, CR1L, MUC 17, TMPRSS11B, MUC21, TMPRSS11E, CD207, SLC30A8, CFC1, SLC12A3, SSTR1, GPR27, FZD10, TSHR, SIGLEC15, SLC6A3, KISS1R, QRFPR, GPR119, CLDN6, UPK2, ADAM12, SLC45A3, ACPP, MUC21, MUC16, MS4A12, ALPP, CEA, EphA2, FAP, GPC3, IL13-Ra2, Mesothelin, PSMA, ROR1, VEGFR-II, GD2, FR-α, ErbB2, EpCAM, EGFRvIII, B7-H3, or EGFR.

361. The composition or the method of embodiment 354, wherein the solid tumor antigen is or comprises tumor associated MUC1.

362. The composition or the method of one of embodiments 341-362, wherein the CAR comprises the antigen binding domain, a transmembrane domain, a co-stimulatory domain, and a CD3 zeta domain.

363. The composition or the method of embodiment 362, wherein the co-stimulatory domain comprises the intracellular domain of CD27, CD28, 4-1BB, OX40, CD30, CD40, PD-1, ICOS, lymphocyte function-associated antigen-1 (LFA-1), CD2, CD7, LIGHT, NKG2C, B7-H3, a ligand that specifically binds with CD83, or a combination thereof.

364. The composition or the method of embodiment 362, wherein:
a costimulatory domain of the second CAR comprises or is an intracellular domain of 4-1BB, and a binding domain of the second CAR binds tMUC1; and/or
a binding domain of the first CAR binds CD19 and a costimulatory domain of the second CAR comprises or is an intracellular domain of CD28.

365. The composition or the method of any of embodiment 341-364, wherein the first population of cells and/or the second population of cells further comprise a dominant negative form of PD-1.

366. The composition or the method of embodiment 365, wherein the first population of cells comprise a vector encoding the first CAR and the dominant negative form of PD-1.

367. The composition or the method of one of embodiments 341-366, wherein the first CAR comprises a scFv binding tMUC1, an intracellular domain of 4-1BB or CD28, CD3 zeta domain, and the second CAR comprises a scFv binding CD19, an intracellular domain of 4-1BB or CD28, CD3 zeta domain.

368. The composition or the method of one of embodiments 341-367, wherein the first CAR comprises SEQ ID NO: 5, and the second CAR comprise the SEQ ID NO: 70.

369. The composition or the method of one of embodiments 341-368, wherein the second population of cells comprises a lentiviral vector encoding the first CAR and a therapeutic agent and the first population of cells comprises a lentiviral vector encoding the second CAR and a dominant negative form of PD-1.

370. The composition or the method of one of embodiments 341-369, wherein the first population of cells comprise the first CAR and a therapeutic agent and the second population of cells comprise the second CAR and a dominant negative form of PD-1.

371. The composition or the method of one of embodiments 369 and 370, wherein the therapeutic agent comprises or is a cytokine.

372. The composition or the method of embodiment 371, wherein the cytokine is IL6 and/or INFγ.

373. A method comprising:
administering an effective amount of a first population of T cells comprising a CAR comprising a scFv binding CD19, an intracellular domain of 4-1BB or CD28, CD3 zeta domain to the patient, thereby enhancing expansion of the first population of T cells in the patient; and
administering an effective amount of a second population of T cells comprising a CAR comprising a scFv binding tMUC1 to a patient having cancer, an intracellular domain of 4-1BB or CD28, CD3 zeta domain.

374. The method of embodiment 373, wherein first population of cells further comprise an additional CAR comprising the scFv binding tMUC1, the intracellular domain of 4-1BB or CD28, and the CD3 zeta domain.

375. The method of embodiment 373, wherein the second population of cells does not comprise the scFv binding CD19.

376. The method of embodiment 373, wherein the first population of cells does not comprise the scFv binding tMUC1.

EXAMPLES

Example 1. Expression of CARs on T cells

Lentiviral vectors that encode a CD19 CAR (CAR: SEQ ID NO. 207 and scFv: SEQ ID NO. 6) and tumor associated MUC1 CAR (CAR: SEQ ID NO. 202 and scFv: SEQ ID NO. 70) were generated, as shown in FIG. 1 (see "Chimeric Receptors Containing CD137 Signal Transduction Domains Mediate Enhanced Survival of T Cells and Increased Anti-leukemic Efficacy In Vivo," Molecular Therapy, August 2009, vol. 17 no. 8, 1453-1464 incorporated herein by reference in its entirety).

Primary T cells were obtained from patients. The obtained primary T cells were transduced with lentiviral vectors to obtain modified T cells. Flow-cytometry was performed and analyzed to confirm the expression of CARs in primary T cells (See FIGS. 6A-6F). Techniques related to cell cultures, construction of lentiviral vectors, and flow cytometry may be found in "Control of large, established tumor xenografts with genetically retargeted human T cells containing CD28 and CD137 domains," PNAS, Mar. 3, 2009, vol. 106 no. 9, 3360-3365, which is incorporated herein by reference in its entirety.

Example 2. IFN-γ release in co-cultivation assays I

Figure 7:
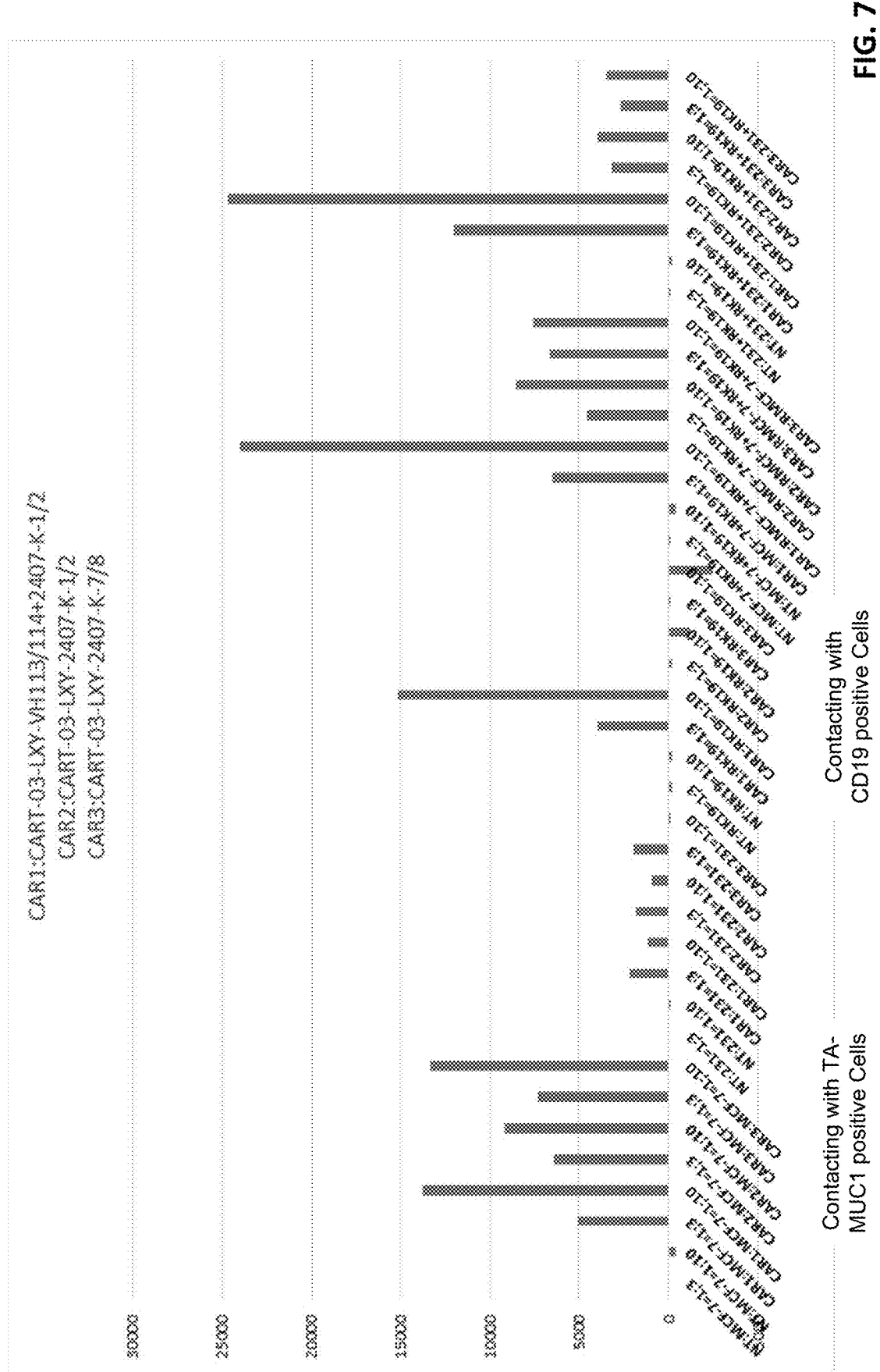
FIG. 7 shows functional analysis of T cells expressing anti-CD19 CAR and anti-MUC1 CAR.
Figure 8:
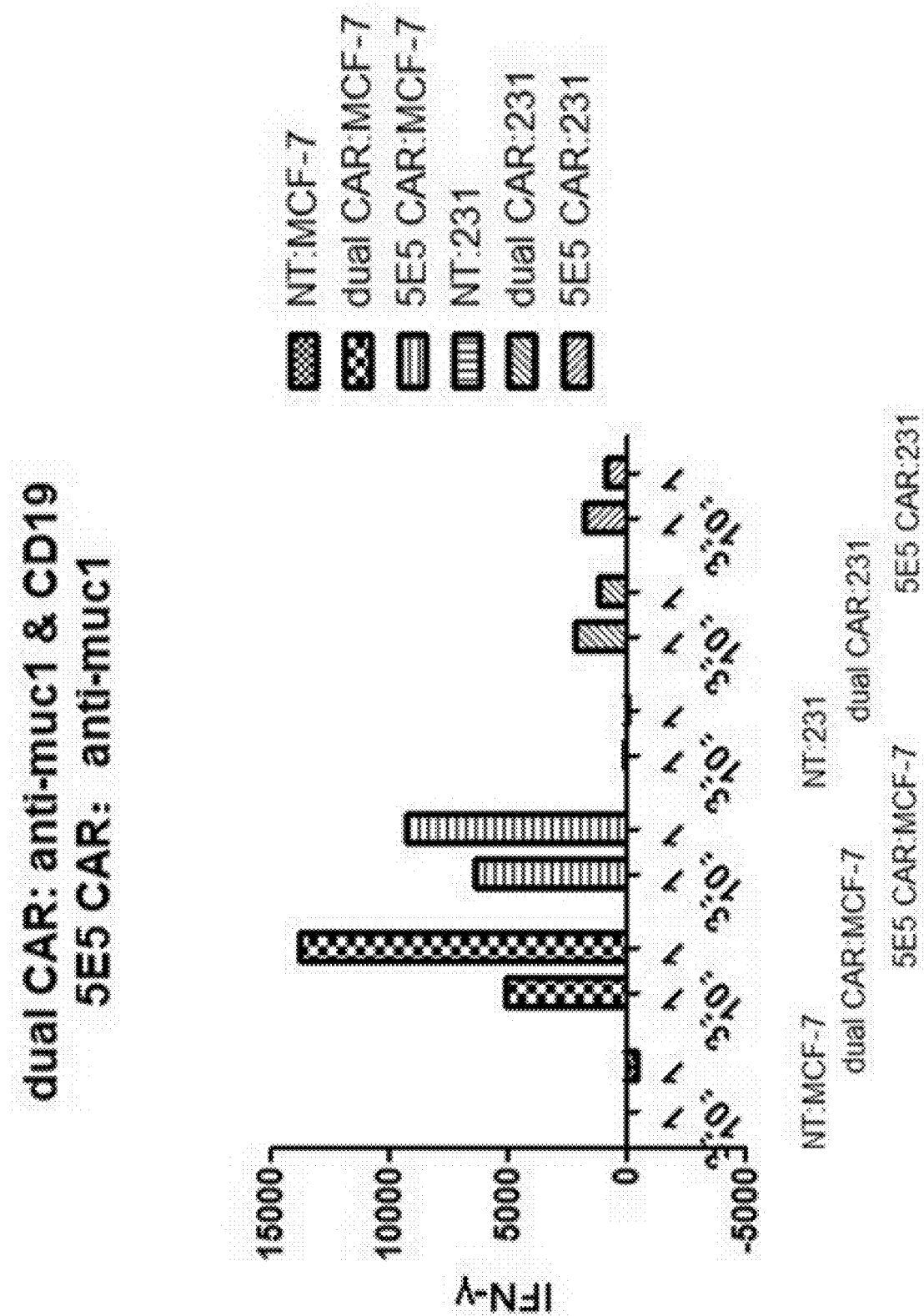
FIG. 8 displays a histogram showing T cell response to co-culturing with various substrate cells.
Figure 9:
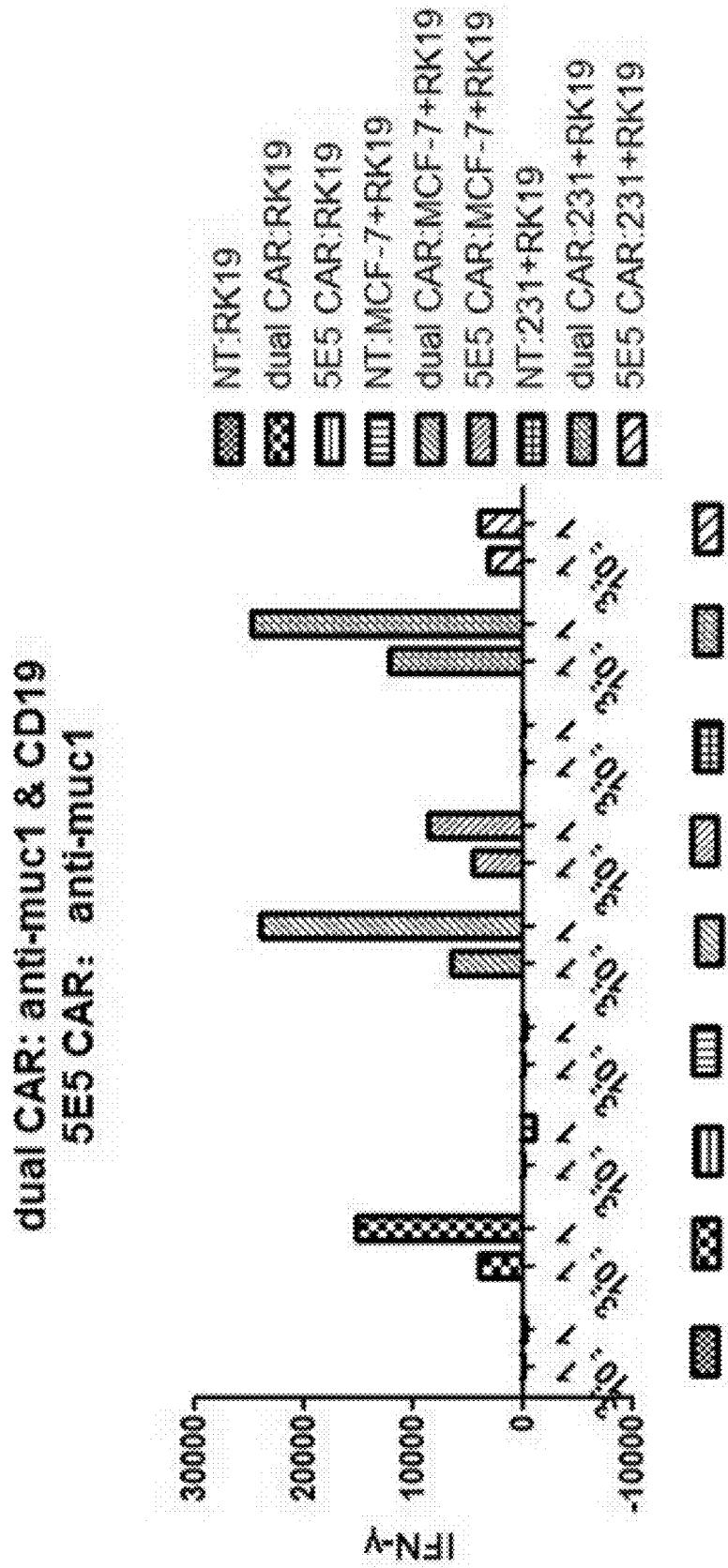
FIG. 9 displays a histogram showing T cell response to co-culturing with various substrate cells.

T cells were transfected with the lentiviral vectors encoding dual CARs (CD19 and TA-MUC1 CARs, see dual CARs in FIGS. 8 and 9) and lentiviral vectors encoding single CAR (TA-MUC1 CAR, see 5E5 CAR in FIGS. 8 and 9), respectively. Two types of T cells and different single type or multiple types of substrate cells were co-cultured and the release of IFN-γ was observed. Substrate cells include MUC1-positive tumor cells (MCF-7), MUC1-negative tumor cells (231), and CD19-positive tumor cells (RK19). A ratio of E: T (Effector Cell: Target Cell) 1: 1/3: 1/10: 1/30:1 (i.e., CAR T cells: target tumor cells) of CAR T cells and target tumor cells were co-cultured for 24 hours. Subsequently, the supernatant was collected, and release of IFN-γ was measured. Various levels of IFN-γ release were observed when CAR T cells and the substrate cells were co-cultured (See FIG. 7). As further shown in FIGS. 8 and 9, dual CAR T cells released IFN-γ in response to co-culturing with CD19-positive tumor cells and MUC1-positive tumor cells, while single CAR T cells released little IFN-γ in response to co-culturing with CD19-positive tumor cells. Further, in response to co-culturing with CD19-positive tumor cells and MUC1-positive tumor cells, dual CAR T cells released a greater amount of IFN-γ as compared to single CAR T cells. Techniques related to cell cultures, construction of cytotoxic T-lymphocyte assay may be found in "Control of large, established tumor xenografts with genetically retargeted human T cells containing CD28 and CD137 domains," PNAS, Mar. 3, 2009, vol. 106 no. 9, 3360-3365, which is incorporated herein by reference in its entirety.

Example 3. Expression of CAR/antigen on primary T cells

Figure 10A:
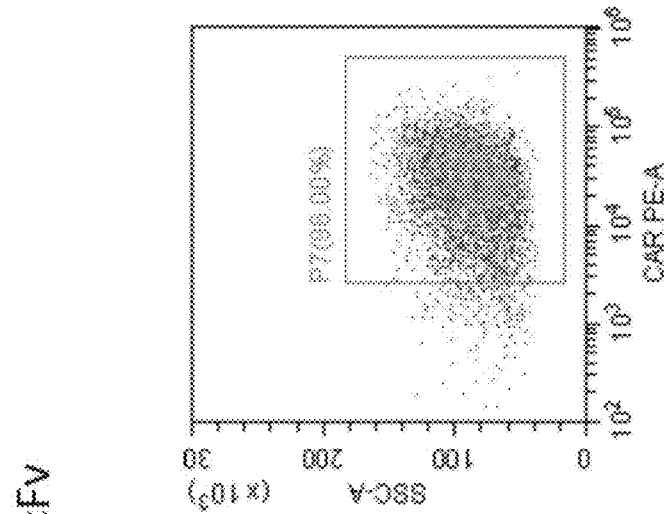
FIGS. 10A-10C display flow cytometry analysis showing expression of anti-TSHR CAR molecules on T cells (Gated by a single live cell). Anti-TSHR CAR T cells were constructed, and the expression of CAR molecules was detected by flow cytometry. Compared to non-transduced (or untransduced) T cells, expression of CAR molecules was observed.
Figure 10B:
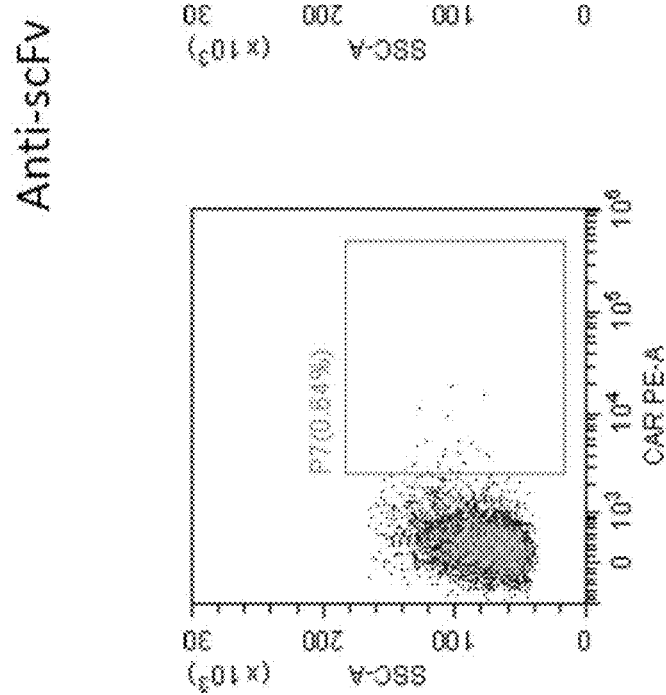
Figure 10C:
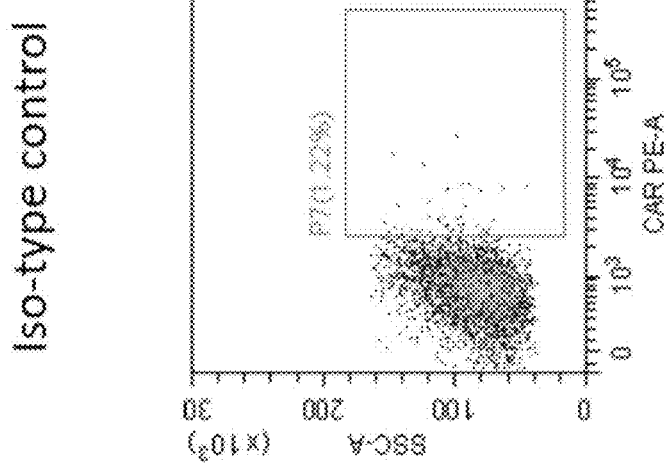
Figure 11B:
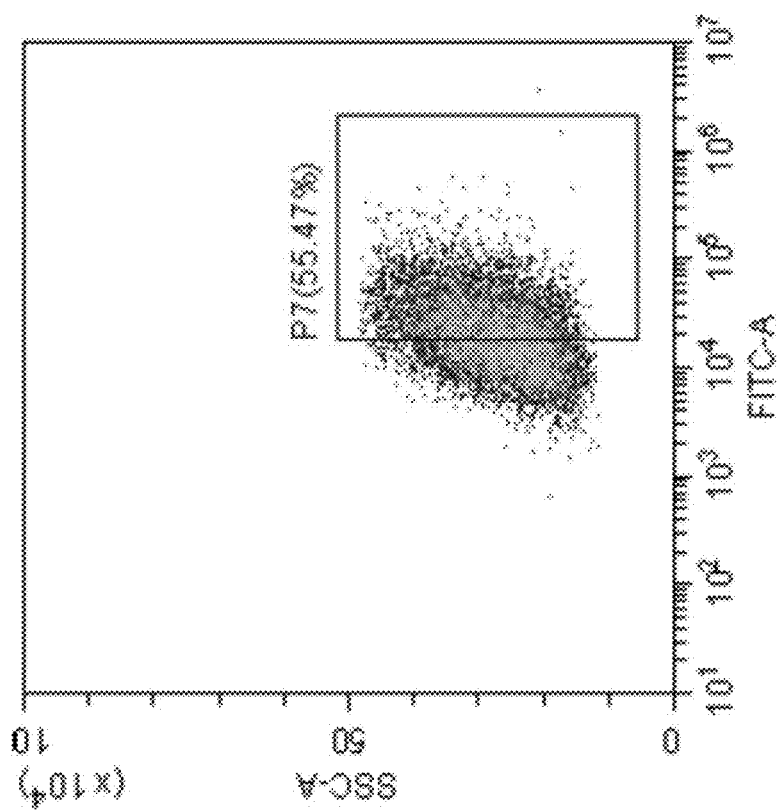
FIGS. 11A-11B display flow cytometry analysis showing overexpression of TSHR on T cells (Gated by a single live cell). Lentiviral vectors were used to construct antigen over-expressed T cells (TSHR). The expression of TSHR molecules on the surface of T cells was observed (IgG on the left and anti-TSHR FITC on the right).
Figure 11A:
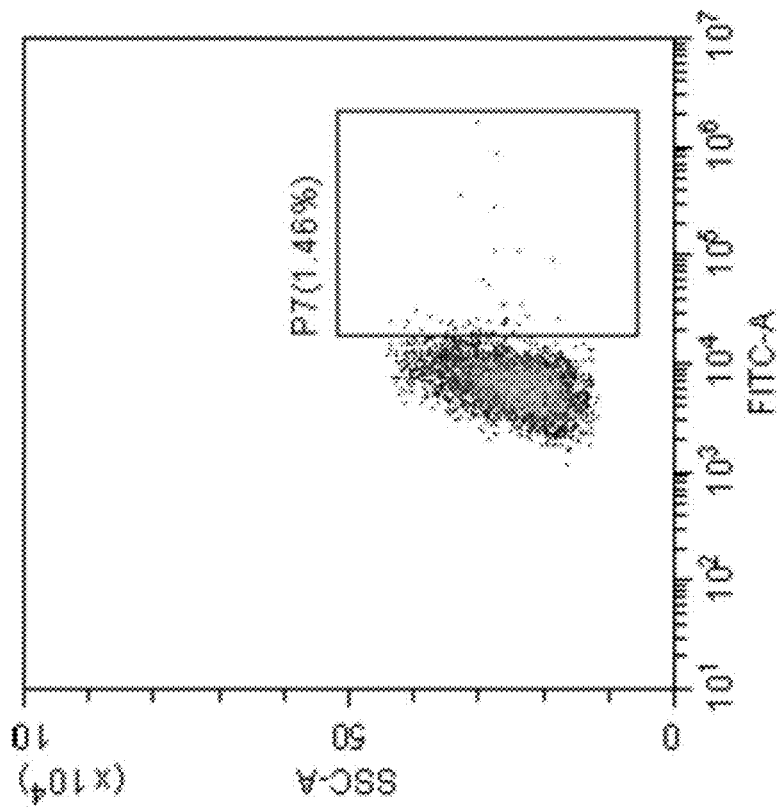

Primary T cells were obtained from a patient. The obtained primary T cells were divided into two groups. Primary T cells in Group 1 were transduced with lentiviral vectors including a nucleic acid sequence encoding Anti-TSHR CAR (SEQ ID: 8). Primary T cells in Group 2 were transduced with lentiviral vectors including a nucleic acid sequence encoding TSHR (SEQ ID: 20). Flow-cytometry was performed and analyzed to determine the expression of CAR and TSHR in primary T cells, respectively (FIGS. 10 and 11). Techniques related to cell cultures, construction of lentiviral vectors, and flow cytometry may be found in "Control of large, established tumor xenografts with genetically retargeted human T cells containing CD28 and CD137 domains," PNAS Mar. 3, 2009, vol. 106 no. 9, 3360-3365, which is incorporated herein by reference in its entirety.

Example 4. In vivo cytokine release assay

Figure 12:
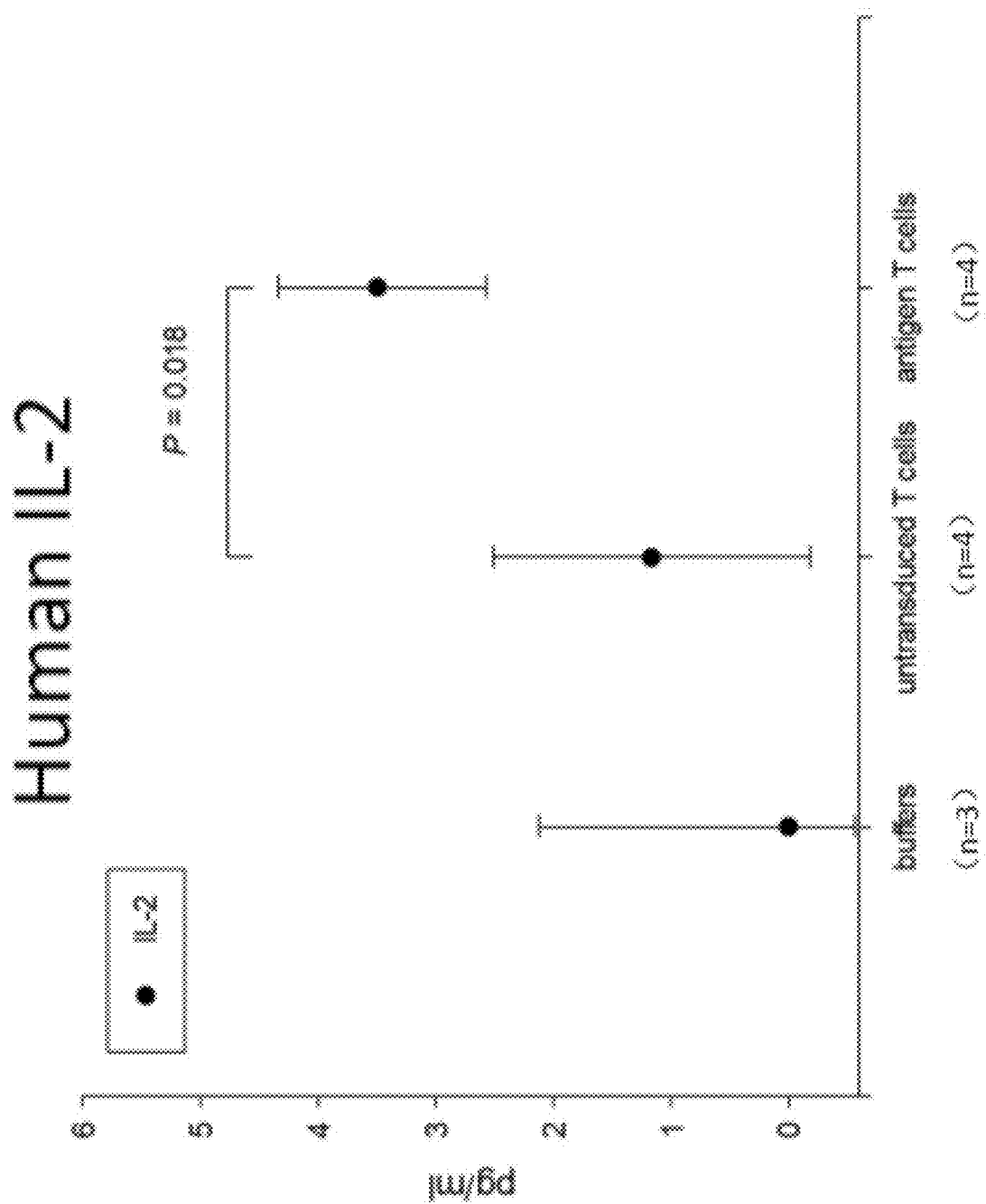
FIG. 12 shows cytokine release (IL-2) in mouse peripheral blood.
Figure 13:
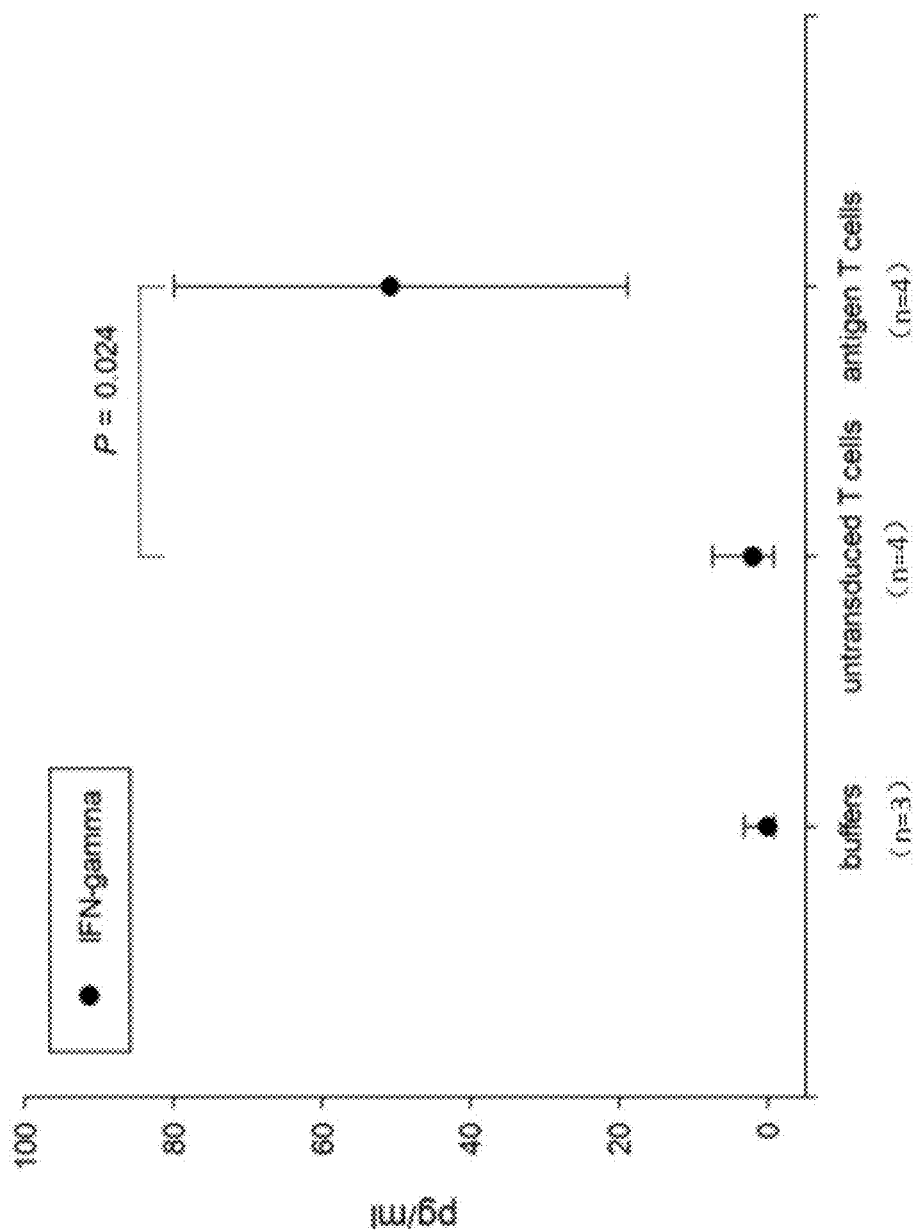
FIG. 13 shows cytokine release (IFN-γ) in mouse peripheral blood.
Figure 14:
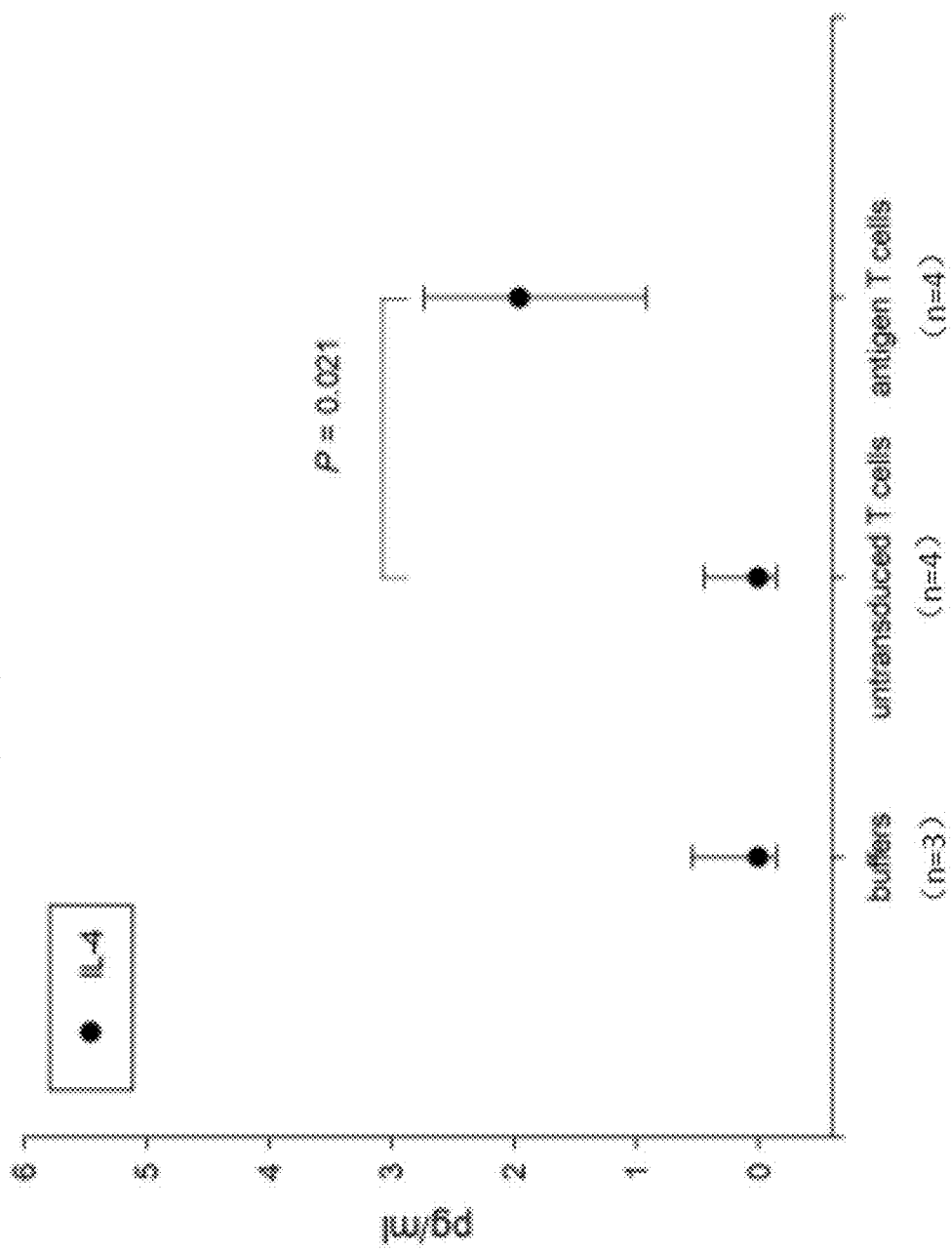
FIG. 14 shows cytokine release (IL-4) in mouse peripheral blood.
Figure 16A:
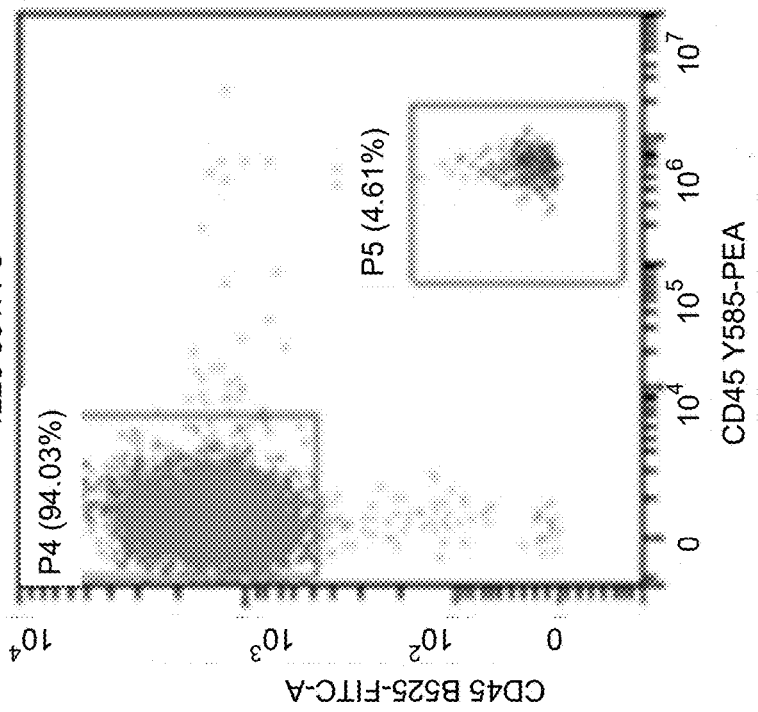
FIGS. 16A-16B, 17A-17B, 18A-18B, and 19A-19B show flow cytometry results of human leukocytes/murine leukocytes in different groups. The cells were derived from all living cells after the mouse peripheral blood lysis. The horizontal axis represents the fluorescence intensity of hCD45 corresponding staining, and the vertical axis represents the fluorescence intensity of mCD45 corresponding staining.
Figure 16B:
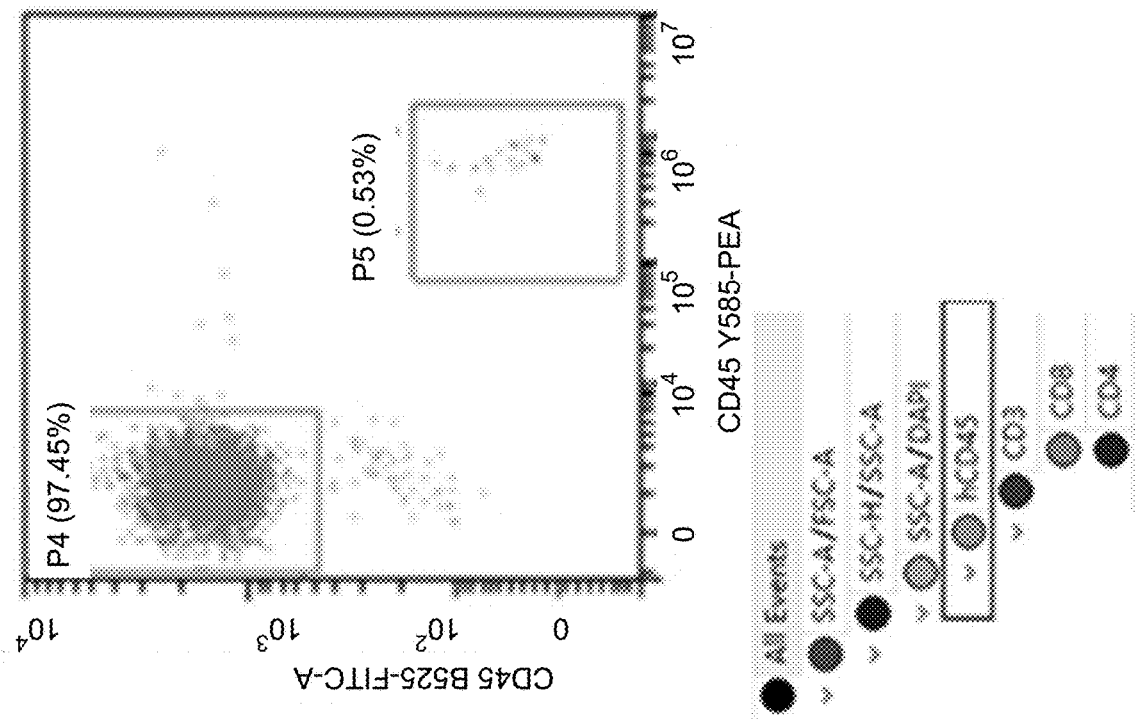
Figure 17B:
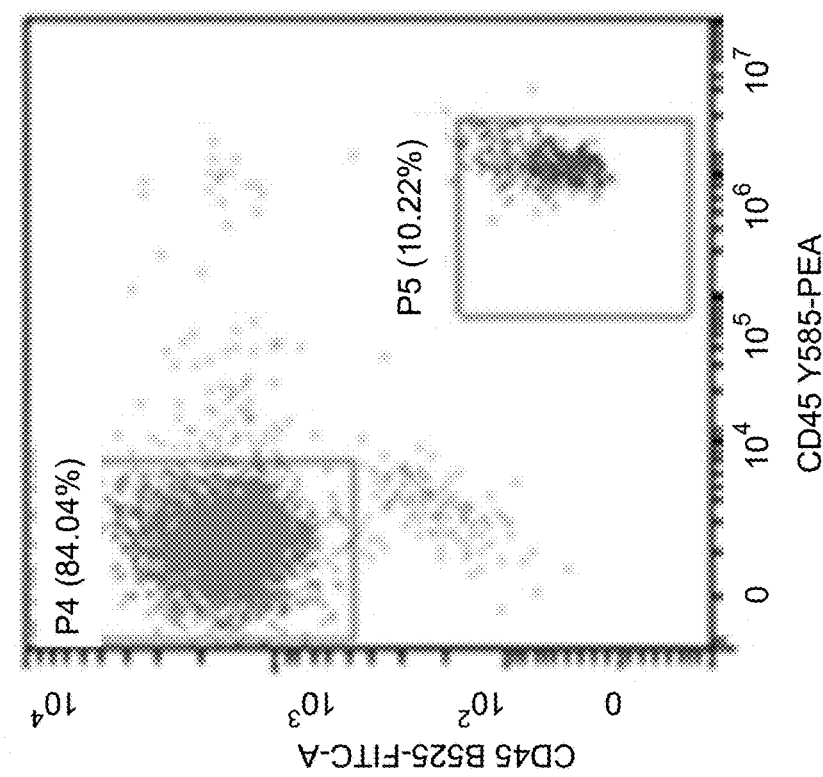
Figure 17A:
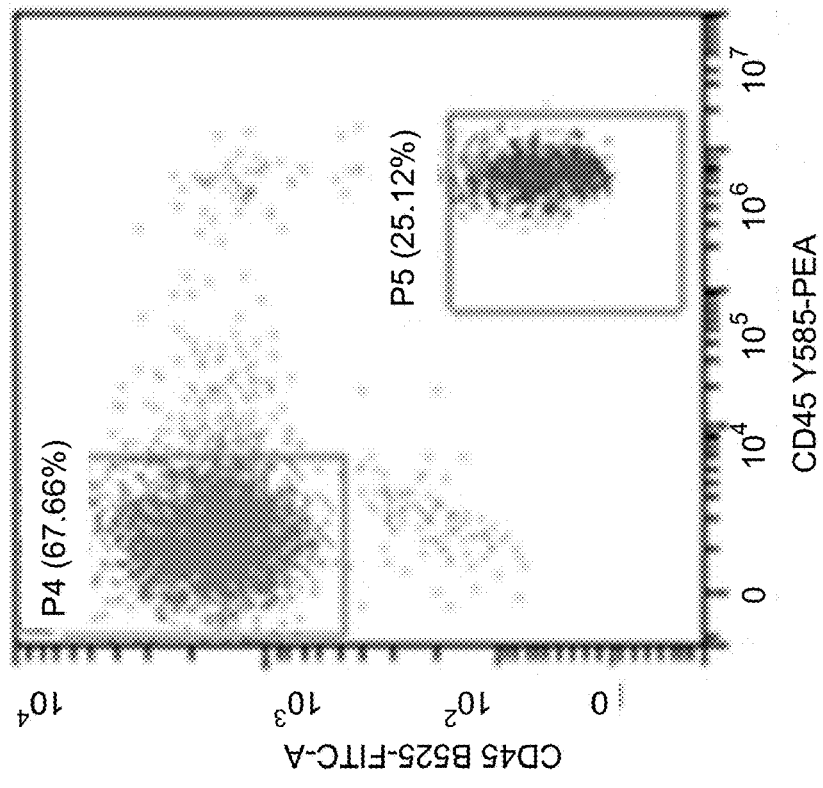
Figure 18A:
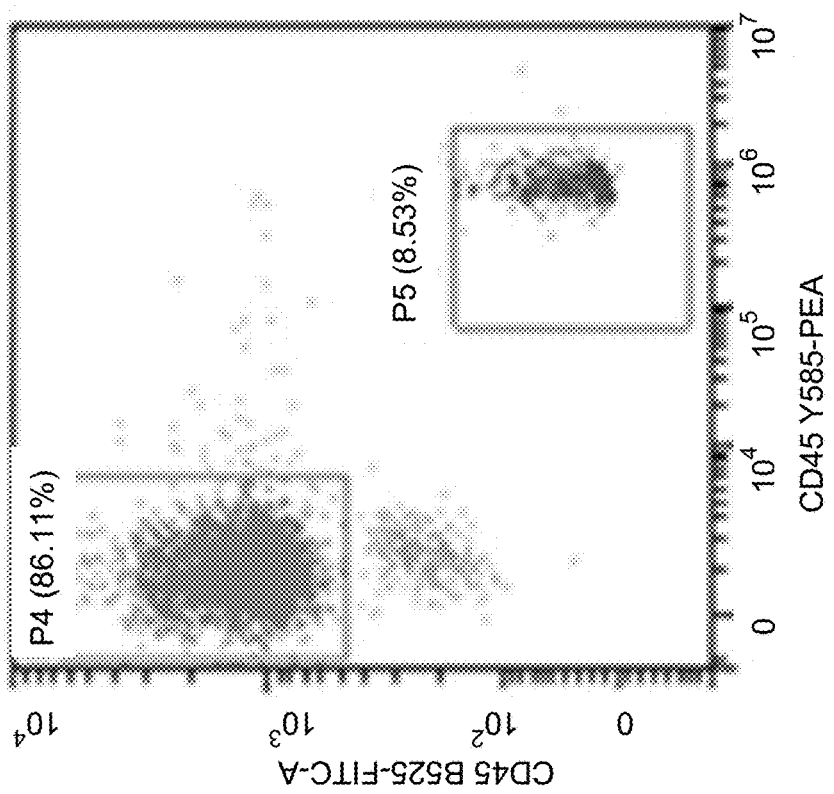
Figure 18B:
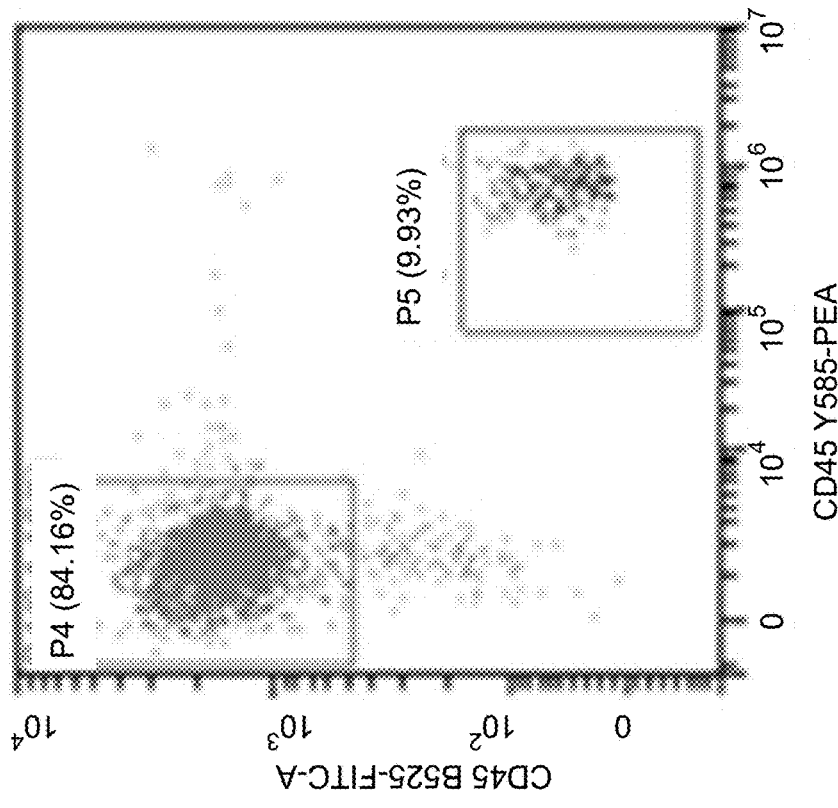
Figure 19A:
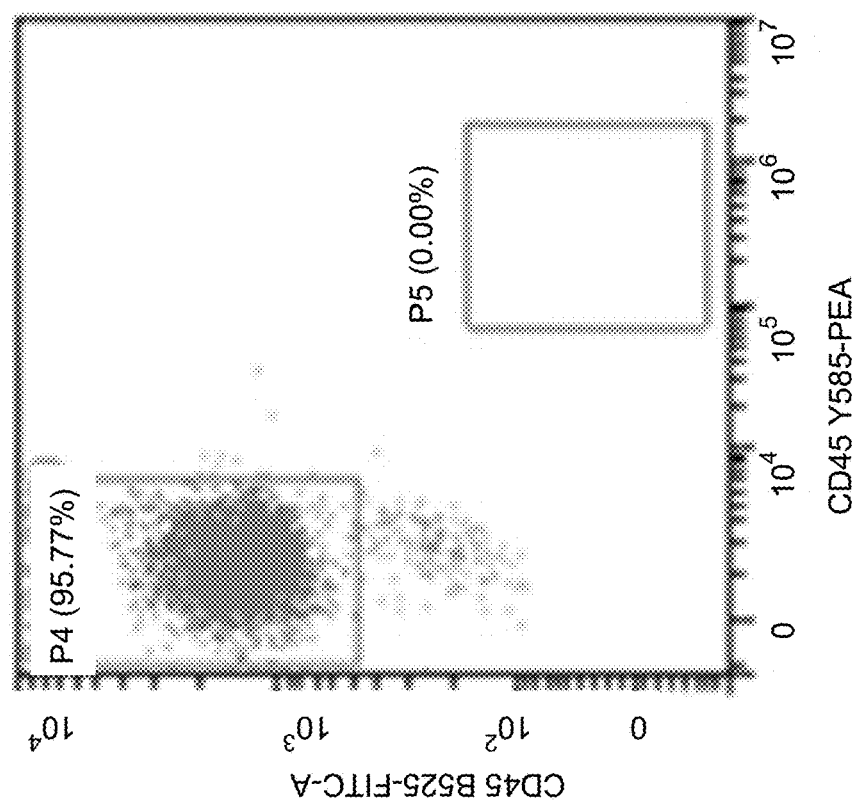
Figure 19B:
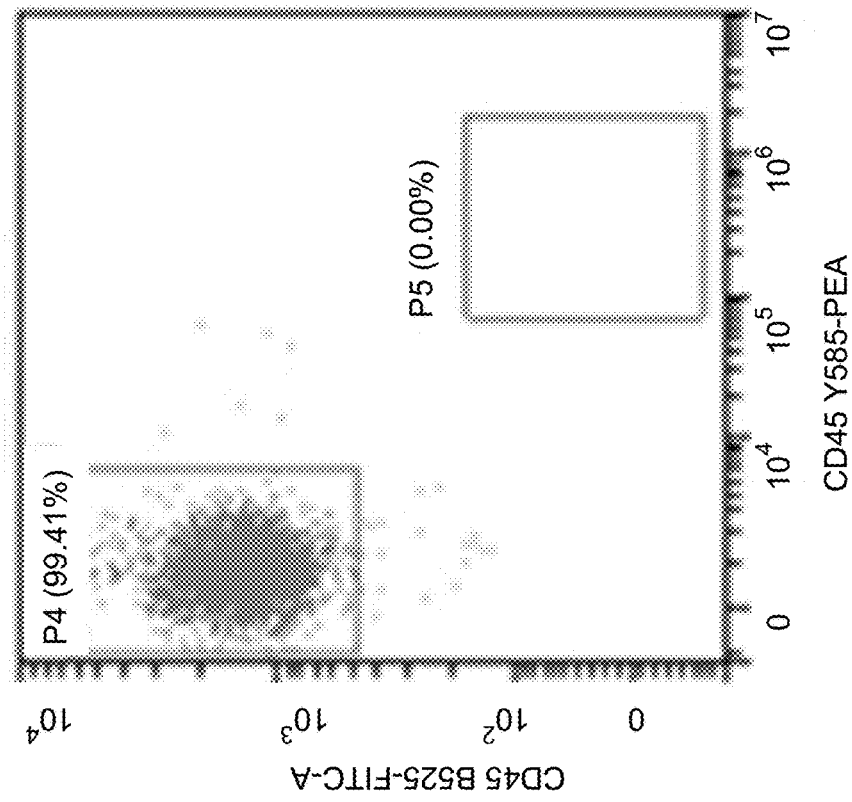
Figure 23A:
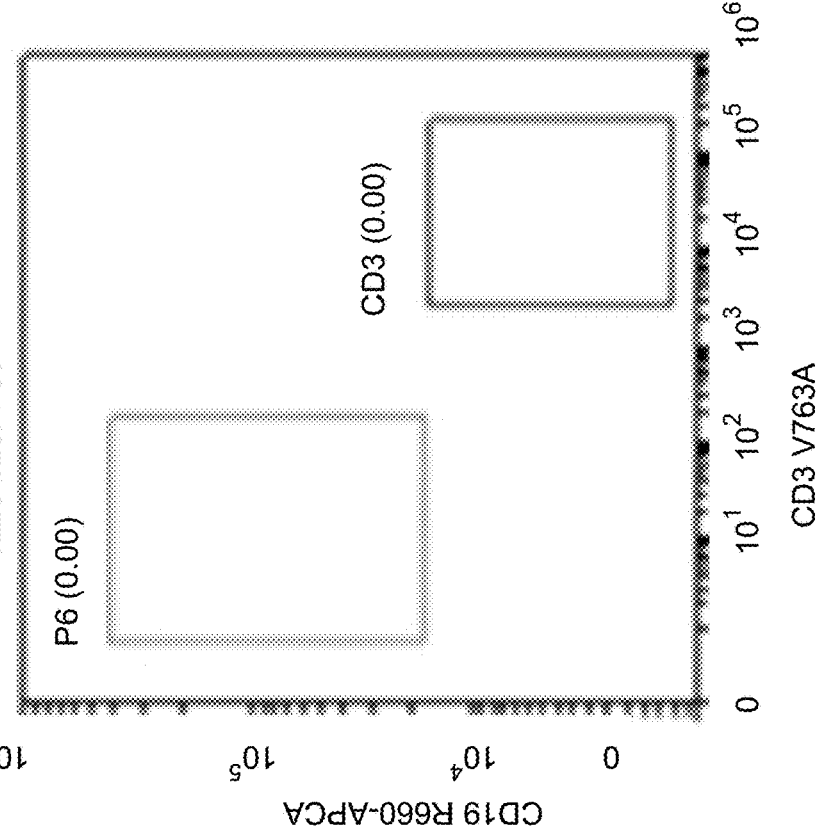
Figure 23B:
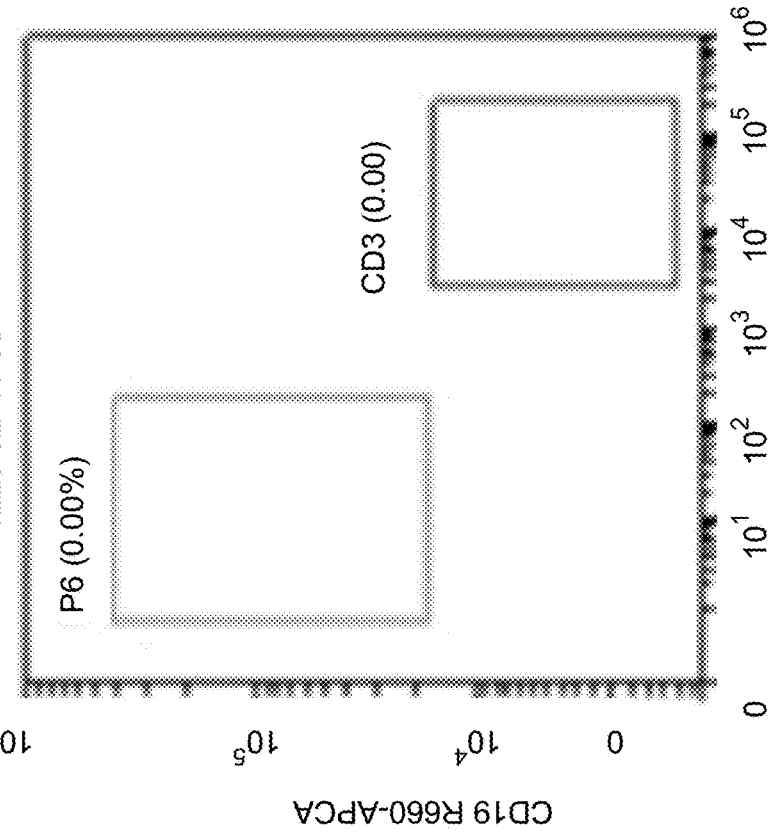

Primary T cells of Group 1 and Group 2 were infused into mice (Experimental Group). As a control, Primary T cells of Group 1 alone or buffer were infused into mice (Control Group 1 and Control Group 2). Several parameters regarding cell infusion are provided in Table 2 below. NPG™ (NOD Prkdc$^{scid}$ IL2rg$^{null}$) mice were irradiated, and a certain number of CAR T cells and corresponding control agents were infused into mice. For Control Group 2, three consecutive buffers were returned to the mice. For Control Group 1, T cells that did not express antigen were returned three times in succession. For Experimental Group, T cells expressing antigens were continuously transfused three times in succession. After the transfusion was completed, blood from the limbal vein was collected to analyze the T cells and factor release (e.g., cytokine release) in the peripheral blood of the mice. The mice were then sacrificed, and T ratios of each organ/CAR T Cell ratio/CAR T copy and other data were collected. Cytokine release assay was then performed. Various cytokines (e.g., IFN-γ, IL4, IL2) in mice peripheral blood were measured for Experimental Group and Control Group. As shown in FIGS. 12-14, the amount of cytokine released in the Experimental Group was greater than those in the Control Group. These results demonstrate that infusion of cells expressing an antigen enhances the corresponding CAR T cells' T cell response. Table 2 summarizes the infusion of T cells into mice, and Table 3 provides the schedule for in vivo analysis cytokine release.

TABLE 2

| Experimental Group | Control Group 1 | Control Group 2 |
|---|---|---|
| Anti-TSHR CAR T cells about 4 × 10$^6$/mouse Antigen T (TSHR-overexpressed T cell) about 4 × 10$^6$/mouse per time | Anti-TSHR CAR T cells about 4 × 10$^6$/mouse NT (non-transduced T cell) about 4 × 10$^6$/mouse per time | Anti-TSHR CAR T cells about 4 × 10$^6$/mouse NT (non-transduced T cell) about 4 × 10$^6$/mouse per time |

TABLE 3

| Day 1 | Day 3 | Day 5 | Day 9 | Day 12 | Day 14 | Day 21 | Day 28 |
|---|---|---|---|---|---|---|---|
| irradiation at 1.5 Gy | anti-TSHR CAR T cells infusion | buffers/nt/ antigen T infusion | buffers/nt/ antigen T infusion | buffers/nt/ antigen T infusion | bleeding and analysis | bleeding and analysis | sacrifice and analysis |

The following table (Table 4) shows various polypeptide domains and nucleic acid constructs and their Sequence Identifiers (SEQ ID NO). As examples, CD19 refers to CD19 CAR, which is a CAR containing an antigen binding domain that binds CD19; MUC1 refers to tMUC1 CAR, which is a CAR containing an antigen binding domain that binds tMUC1; and A, B, C, and D refer to specific sequences of hinge and/or transmembrane domain of corresponding CARs.

TABLE 4

| Name | SEQ ID NO: | Name | SEQ ID NO: | Name | SEQ ID No: |
|---|---|---|---|---|---|
| SP | 1 | UPK2 | 101 | Construct of MUC1-5E5-A-IRES-CD19-A | 201 |
| Hinge & transmembrane domain | 2 | ADAM12 | 102 | CAR 1 of MUC1-5E5-A-IRES-CD19-A | 202 |
| Co-stimulatory domain | 3 | SLC45A3 | 103 | CAR 2 of MUC1-5E5-A-IRES-CD19-A | 203 |
| CD3-zeta | 4 | ACPP | 104 | Construct of MUC1-5E5-B-IRES-CD19-A | 204 |
| scFv Humanized CD19 | 5 | MUC21 | 105 | CAR 1 of MUC1-5E5-B-IRES-CD19-A | 205 |
| scFv CD19 | 6 | MUC16 | 106 | CAR 2 of MUC1-5E5-B-IRES-CD19-A | 203 |
| scFv FZD10 | 7 | MS4A12 | 107 | Construct of MUC1-5E5-A-IRES-CD19-B | 206 |
| scFv TSHR | 8 | ALPP | 108 | CAR 1 of MUC1-5E5-A-IRES-CD19-B | 202 |
| scFv PRLR | 9 | SLC2A14 | 109 | CAR 2 of MUC1-5E5-A-IRES-CD19-B | 207 |
| scFv MUC_17 | 10 | GS1-259H13.2 | 110 | Construct of MUC1-5E5-B-IRES-CD19-B | 208 |
| scFv GUCY2C | 11 | ERVFRD-1 | 111 | CAR 1 of MUC1-5E5-B-IRES-CD19-B | 205 |

TABLE 4-continued

| Name | SEQ ID NO: | Name | SEQ ID NO: | Name | SEQ ID No: |
|---|---|---|---|---|---|
| scFv CD207 | 12 | ADGRG2 | 112 | CAR 2 of MUC1-5E5-B-IRES-CD19-B | 207 |
| Prolactin (ligand) | 13 | ECEL1 | 113 | Construct of MUC1-2-A-IRES-CD19-A | 209 |
| scFv CD3 | 14 | CHRNA2 | 114 | CAR 1 of MUC1-2-A-IRES-CD19-A | 210 |
| scFv CD4 | 15 | GP2 | 115 | CAR 2 of MUC1-2-A-IRES-CD19-A | 203 |
| scFv CD4-2 | 16 | PSG9 | 116 | Construct of MUC1-2-B-IRES-CD19-A | 211 |
| scFv CD5 | 17 | SIGLEC15 | 117 | CAR 1 of MUC1-2-B-IRES-CD19-A | 212 |
| CD19 antigen | 18 | SLC6A3 | 118 | CAR 2 of MUC1-2-B-IRES-CD19-A | 203 |
| FZD10 antigen | 19 | KISS1R | 119 | Construct of MUC1-2-A-IRES-CD19-B | 213 |
| TSHR antigen | 20 | QRFPR | 120 | CAR 1 of MUC1-2-A-IRES-CD19-B | 210 |
| PRLR antigen | 21 | GPR119 | 121 | CAR 2 of MUC1-2-A-IRES-CD19-B | 207 |
| MUC17 antigen | 22 | CLDN6 | 122 | Construct of MUC1-2-B-IRES-CD19-B | 214 |
| GUCY2C antigen | 23 | SP-2 | 123 | CAR 1 of MUC1-2-B-IRES-CD19-B | 212 |
| CD207 antigen | 24 | Linker-2 | 124 | CAR 2 of MUC1-2-B-IRES-CD19-B | 207 |
| CD3 antigen | 25 | Hinge-2 | 125 | Construct of MUC1-5E5-A-IRES-hCD19-A | 215 |
| CD4 antigen | 26 | TM-2 | 126 | CAR 1 of MUC1-5E5-A-IRES-hCD19-A | 202 |
| CD5 antigen | 27 | 4-1BB-2 | 127 | CAR 2 of MUC1-5E5-A-IRES-hCD19-A | 216 |
| CAR CD19 nucleic acid | 28 | CD3 zeta-2 | 128 | Construct of MUC1-5E5-B-IRES-hCD19-A | 217 |
| Hinge & TM domain B | 29 | CLDN6-CAR-1 | 129 | CAR 1 of MUC1-5E5-B-IRES-hCD19-A | 205 |
| Hinge & TM domain A | 30 | ScFv CLDN6-CAR-1 | 130 | CAR 2 of MUC1-5E5-B-IRES-hCD19-A | 216 |
| Hinge & TM domain D | 31 | ScFv VL CLDN6-CAR-1 | 131 | Construct of MUC1-5E5-A-IRES-hCD19-B | 218 |
| Hinge & TM domain C | 32 | ScFv VH CLDN6-CAR-1 | 132 | CAR 1 of MUC1-5E5-A-IRES-hCD19-B | 202 |
| Hinge domain D | 33 | CLDN6-CAR-2 | 133 | CAR 2 of MUC1-5E5-A-IRES-hCD19-B | 219 |
| Hinge domain C | 34 | ScFv CLDN6-CAR-2 | 134 | Construct of MUC1-5E5-B-IRES-hCD19-B | 220 |
| Hinge domain B | 35 | ScFv VL CLDN6-CAR-2 | 135 | CAR 1 of MUC1-5E5-B-IRES-hCD19-B | 205 |
| Hinge domain A | 36 | ScFv VH CLDN6-CAR-2 | 136 | CAR 2 of MUC1-5E5-B-IRES-hCD19-B | 219 |
| TM domain D | 37 | CLDN6-CAR-3 | 137 | Construct of MUC1-2-A-IRES-hCD19-A | 221 |
| TM domain A | 38 | scFv CLDN6-CAR-3 | 138 | CAR 1 of MUC1-2-A-IRES-hCD19-A | 210 |
| CD19 extracellular domain | 39 | scFv VL CLDN6-CAR-3 | 139 | CAR 2 of MUC1-2-A-IRES-hCD19-A | 216 |
| TM domain C or B | 40 | scFv VH CLDN6-CAR-3 | 140 | Construct of MUC1-2-B-IRES-hCD19-A | 222 |
| WTCD3zeta | 41 | CLDN6-CAR-4 | 141 | CAR 2CAR 1 of MUC1-2-B-IRES-hCD19-A | 212 |
| WTCD3zeta-BCMACAR full length | 42 | scFv CLDN6-CAR-4 | 142 | Construct of MUC1-2-B-IRES-hCD19-A | 216 |

TABLE 4-continued

| Name | SEQ ID NO: | Name | SEQ ID NO: | Name | SEQ ID No: |
|---|---|---|---|---|---|
| BCMA | 43 | scFv VL CLDN6-CAR-4 | 143 | Construct of MUC1-2-A-IRES-hCD19-B | 223 |
| BCMA CAR vector | 44 | scFv VH CLDN6-CAR-4 | 144 | CAR 1 of MUC1-2-A-IRES-hCD19-B | 210 |
| BCMA CAR vector | 45 | SIGLEC-15-CAR-1 | 145 | CAR 2 of MUC1-2-A-IRES-hCD19-B | 219 |
| VL anti-CD5 | 46 | scFv SIGLEC-15-CAR-1 | 146 | Construct of MUC1-2-B-IRES-hCD19-B | 224 |
| VH anti-CD5 | 47 | scFv VL SIGLEC-15-CAR-1 | 147 | CAR 1 of MUC1-2-B-IRES-hCD19-B | 212 |
| VL anti-CD4 | 48 | scFv VH SIGLEC-15-CAR-1 | 148 | CAR 2 of MUC1-2-B-IRES-hCD19-B | 219 |
| VH anti-CD4 | 49 | VL1 VH1 SIGLEC-15-CAR-2 | 149 | Construct of MUC1-5E5-A-IRES-CD22-A | 225 |
| VL anti-CD3 | 50 | VL1 VH2 SIGLEC-15-CAR-3 | 150 | CAR 1 of MUC1-5E5-A-IRES-CD22-A | 202 |
| VH anti-CD3 | 51 | VL1 VH3 SIGLEC-15-CAR-4 | 151 | CAR 2 of MUC1-5E5-A-IRES-CD22-A | 226 |
| TSHR extracellular domain | 52 | VL1 VH 4 SIGLEC-15-CAR-5 | 52 | Construct of MUC1-5E5-B-IRES-CD22-A | 227 |
| VH region of BCMA scFv | 53 | VL2 VH 1 SIGLEC-15-CAR-6 | 153 | CAR 1 of MUC1-5E5-A-IRES-CD22-A | 205 |
| VL region of BCMA scFv | 54 | VL2 VH2 SIGLEC-15-CAR-7 | 154 | CAR 2 of MUC1-5E5-A-IRES-CD22-A | 226 |
| VH region of CD14 scFv | 55 | VL2 VH3 SIGLEC-15-CAR-8 | 155 | Construct of MUC1-5E5-A-IRES-CD22-B | 228 |
| VL region of CD14 scFv | 56 | VL2 VH4 SIGLEC-15-CAR-9 | 156 | MUC1-5E5-A-IRES-CD22-B CAR 1 | 202 |
| VH region of CD33 scFv | 57 | VL1 SIGLEC-15-CAR | 157 | MUC1-5E5-A-IRES-CD22-B CAR 2 | 229 |
| VL region of CD33 scFv | 58 | VL2 SIGLEC-15-CAR | 158 | MUC1-5E5-B-IRES-CD22-B | 230 |
| CD22CAR | 59 | VH1 SIGLEC-15-CAR | 159 | CAR 1 of MUC1-5E5-B-IRES-CD22-B | 205 |
| BCMACAR | 60 | VH2 SIGLEC-15-CAR | 160 | CAR 2 of MUC1-5E5-B-IRES-CD22-B | 229 |
| MUC1CAR | 61 | VH3 SIGLEC-15-CAR | 161 | Construct of MUC1-2-A-IRES-CD22-A | 231 |
| m19CAR-IRES-MUC1CAR | 62 | VH4 SIGLEC-15-CAR | 162 | CAR 1 of MUC1-2-A-IRES-CD22-A | 210 |
| hCD19CAR-IRES-MUC1CAR | 63 | MUC16-CAR-1 | 163 | CAR 2 of MUC1-2-A-IRES-CD22-A | 226 |
| hCD22CAR-IRES-MUC1CAR | 64 | scFv MUC16-CAR-1 | 164 | MUC1-2-B-IRES-CD22-A | 232 |
| BCMACAR-IRES-MUC1CAR | 65 | scFv VL MUC16-CAR-1 | 165 | MUC1-2-B-IRES-CD22-A CAR 1 | 212 |
| mCD19CAR-2A-MUC1CAR | 66 | scFv VH MUC16-CAR-1 | 166 | MUC1-2-B-IRES-CD22-A CAR 2 | 226 |
| hCD19CAR-2A-MUC1CAR | 67 | MUC16-CAR-2 | 167 | MUC1-2-A-IRES-CD22-B | 233 |
| hCD22CAR-2A-MUC1CAR | 68 | scFv MUC16-CAR-2 | 168 | MUC1-2-A-IRES-CD22-B CAR 1 | 210 |
| BCMA-2A-MUC1CAR | 69 | scFv VL MUC16-CAR-2 | 169 | MUC1-2-A-IRES-CD22-B CAR 2 | 229 |
| Tumor associated MUC1 scFv 1 | 70 | scFv VH MUC16-CAR-2 | 170 | Construct of MUC1-2-B-IRES-CD22-B | 234 |
| Tumor associated MUC1 scFv-1 VH | 71 | KISS1R-CAR | 171 | CAR 1 of MUC1-2-B-IRES-CD22-B | 212 |
| Tumor associated MUC1 scFv-1 VL | 72 | Ligent peptide KISS1R-CAR | 172 | CAR 2 of MUC1-2-B-IRES-CD22-B | 229 |
| Tumor associated MUC1 scFv-1 VL CDR 1 | 73 | ZFLm1 (left) RS aa | 173 | Construct of MUC1-5E5-A-IRES-CD14-A | 235 |
| L2D8-2 (hCAR VL) | 74 | ZFLm1 (left) F1 | 174 | CAR 1 of MUC1-5E5-A-IRES-CD14-A | 202 |
| Tumor associated MUC1 scFv-1 VL CDR 3 | 75 | ZFLm1 (left) F2 | 174 | CAR 2 of MUC1-5E5-A-IRES-CD14-A | 236 |
| Tumor associated MUC1 scFv-1 VH CDR 1 | 76 | ZFLm1 (left) F3 | 176 | Construct of MUC1-5E5-B-IRES-CD14-A | 237 |
| Tumor associated MUC1 scFv-1 VH CDR 2 | 77 | ZFLm1 (left) F4 | 177 | CAR 1 of MUC1-5E5-B-IRES-CD14-A | 205 |

TABLE 4-continued

| Name | SEQ ID NO: | Name | SEQ ID NO: | Name | SEQ ID No: |
|---|---|---|---|---|---|
| Tumor associated MUC1 scFv-1 VH CDR 3 | 78 | ZFLm1 (left) F5 | 178 | CAR 2 of MUC1-5E5-B-IRES-CD14-A | 236 |
| Tumor associated MUC1 scFv 2 | 79 | ZFLm1 (left) F6 | 179 | Construct of MUC1-5E5-A-IRES-CD14-B | 238 |
| Tumor associated MUC1 scFv2 VH | 80 | ZFRm1-4 (right) RS aa | 180 | CAR 1 of MUC1-5E5-A-IRES-CD14-B | 202 |
| Tumor associated MUC1 scFv2 VL | 81 | ZFRm1-4 (right) F1 | 181 | CAR 2 of MUC1-5E5-A-IRES-CD14-B | 239 |
| Tumor associated MUC1 scFv-2 VL CDR 1 | 82 | ZFRm1-4 (right) F2 | 182 | Construct of MUC1-2-A-IRES-CD14-A | 240 |
| Tumor associated MUC1 scFv-2 VL CDR 2 | 83 | ZFRm1-4 (right) F3 | 184 | CAR 1 of MUC1-2-A-IRES-CD14-A | 210 |
| Tumor associated MUC1 scFv-2 VL CDR 3 | 84 | ZFRm1-4 (right) F4 | 184 | CAR 2 of MUC1-2-A-IRES-CD14-A | 236 |
| 'Tumor associated MUC1 scFv-2VH CDR 1 | 85 | δ chain-1 of Vγ9Vδ2 | 185 | Construct of MUC1-2-B-IRES-CD14-A | 241 |
| Tumor associated MUC1 scFv-2 VH CDR 2 | 86 | γ chain-2 of Vγ9Vδ2 | 186 | CAR 1 of MUC1-2-B-IRES-CD14-A | 212 |
| Tumor associated MUC1 scFv-2 VH CDR 3 | 87 | δ chain-2 of Vγ9Vδ2 | 187 | CAR 2 of MUC1-2-B-IRES-CD14-A | 236 |
| GSTA motif | 88 | Vγ9Vδ2 TCR-1: DG. SF13 γ chain | 188 | Construct of MUC1-2-A-IRES-CD14-B | 242 |
| Modified PD-1 intracellular domain-1 | 89 | Vγ9Vδ2 TCR-1: DG. SF13 δ chain | 189 | CAR 1 of MUC1-2-A-IRES-CD14-B | 210 |
| Modified PD-1 intracellular domain-2 | 90 | Vγ9Vδ2 TCR-2: DG. SF68: γ chain | 190 | CAR 2 of MUC1-2-A-IRES-CD14-B | 239 |
| Modified PD-1 intracellular domain-3 | 91 | Vγ9Vδ2 TCR-2: DG. SF68: δ chain | 191 | Construct of MUC1-2-B-IRES-CD14-B | 243 |
| Modified PD-1 intracellular domain-4 | 92 | Vγ9Vδ2 TCR-3: 12G12: γ chain | 192 | CAR 1 of MUC1-2-B-IRES-CD14-B | 212 |
| Modified PD-1 intracellular domain-5 | 93 | Vγ9Vδ2 TCR-3: 12G12: δ chain | 193 | CAR 2 of MUC1-2-B-IRES-CD14-B | 239 |
| Removed PD-1 intracellular domain-1 | 94 | Vγ9Vδ2 TCR-4: CP.1.15 γ chain | 194 | Construct of MUC1-5E5-A-IRES-BCMA-A | 244 |
| Removed PD-1 intracellular domain-2 | 95 | TCR-4: CP.1.15δ chain | 195 | CAR 1 of MUC1-5E5-A-IRES-BCMA-A | 202 |
| FokI WC | 96 | WT CD3-zeta | 196 | CAR 2 of MUC1-5E5-A-IRES-BCMA-A | 245 |
| M FokI | 97 | Invariant sequence for iNKT α chain (hVα24-JαQ-TRAC) | 197 | Construct of MUC1-5E5-B-IRES-BCMA-A | 246 |
|  | 98 | An example for iNKT β chain sequence (containing Vβ11): | 198 | CAR 1 of MUC1-5E5-B-IRES-BCMA-A | 205 |
| M FokI |  |  |  |  |  |
| γ chain-1 of Vγ9Vδ2 | 99 | Invariant sequence for MAIT α chain (hAV7S2-AJ33 α chain) (version1) | 199 | CAR 2 of MUC1-5E5-B-IRES-BCMA-A | 245 |
| VL anti-CD4-2 | 100 | VH anti-CD4-2 | 200 | Construct of MUC1-5E5-A-IRES-BCMA-B | 247 |
| CAR 1 of MUC1-2-A-IRES-CD33-A | 210 | CAR 1 of MUC1-5E5-B-IRES-CD33-A | 205 | CAR 1 of MUC1-5E5-A-IRES-BCMA-B | 202 |
| CAR 2 of MUC1-2-A-IRES-CD33-A | 255 | CAR 2 of MUC1-5E5-B-IRES-CD33-A | 255 | CAR 2 of MUC1-5E5-A-IRES-BCMA-B | 248 |
| Construct of MUC1-2-B-IRES-CD33-A | 261 | Construct of MUC1-5E5-A-IRES-CD33-B | 257 | Construct of MUC1-5E5-B-IRES-BCMA-B | 249 |

TABLE 4-continued

| Name | SEQ ID NO: | Name | SEQ ID NO: | Name | SEQ ID No: |
|---|---|---|---|---|---|
| CAR 1 of MUC1-2-B-IRES-CD33-A | 212 | CAR 1 of MUC1-5E5-A-IRES-CD33-B | 202 | CAR 1 of MUC1-5E5-B-IRES-BCMA-B | 205 |
| CAR 2 of MUC1-2-B-IRES-CD33-A | 255 | CAR 2 of MUC1-5E5-A-IRES-CD33-B | 258 | CAR 2 of MUC1-5E5-B-IRES-BCMA-B | 245 |
| Construct of MUC1-2-A-IRES-CD33-B | 262 | Construct of MUC1-5E5-B-IRES-CD33-B | 259 | Construct of MUC1-2-A-IRES-BCMA-A | 250 |
| CAR 1 of MUC1-2-A-IRES-CD33-B | 210 | CAR 1 of MUC1-5E5-B-IRES-CD33-B | 205 | CAR 1 of MUC1-2-A-IRES-BCMA-A | 210 |
| CAR 2 of MUC1-2-A-IRES-CD33-B | 258 | CAR 2 of MUC1-5E5-B-IRES-CD33-B | 258 | CAR 2 of MUC1-2-A-IRES-BCMA-A | 245 |
| Construct of MUC1-2-B-IRES-CD33-B | 263 | Construct of MUC1-2-A-IRES-CD33-A | 260 | Construct of MUC1-2-B-IRES-BCMA-A | 251 |
| CAR 1 of MUC1-2-B-IRES-CD33-B | 212 | Construct of MUC1-2-B-IRES-BCMA-B | 253 | CAR 1 of MUC1-2-B-IRES-BCMA-A | 212 |
| CAR 2 of MUC1-2-B-IRES-CD33-B | 258 | CAR 1 of MUC1-2-B-IRES-BCMA-B | 212 | CAR 2 of MUC1-2-B-IRES-BCMA-A | 245 |
| Construct of MUC1-5E5-A-IRES-CD33-A | 254 | MUC1-2-B-IRES-BCMA-B CAR 2 | 248 | Construct of MUC1-2-A-IRES-BCMA-B | 252 |
| CAR 1 of MUC1-5E5-A-IRES-CD33-A | 202 | MUC1-5E5-B-IRES-CD33-A | 256 | CAR 1 of MUC1-2-A-IRES-BCMA-B | 210 |
| CAR 2 of MUC1-5E5-A-IRES-CD33-A | 255 | CAR 2 of MUC1-2-A-IRES-BCMA-B | 248 | MUC1-5e5Panko-enhanced scFc | 264 |
| MUC1-Panko5e5-enhanced scFc | 265 | hinge and/or transmembrane domain A | 266 | hinge and/or transmembrane domain B | 267 |
| hinge and/or transmembrane domain C | 268 | hinge and/or transmembrane domain D | 269 | MUC1-5e5Panko-enhanced scFc A 41BB CD2 zeta | 270 |
| MUC1-5e5Panko-enhanced scFc B 41BB CD2 zeta | 271 | MUC1-5e5Panko-enhanced scFc C 41BB CD2 zeta | 272 | MUC1-5e5Panko-enhanced scFc D 41BB CD2 zeta | 273 |
| MUC1-Panko5e5-enhanced scFc A 41BB CD2 zeta | 274 | MUC1-Panko5e5-enhanced scFc B 41BB CD2 zeta | 275 | MUC1-Panko5e5-enhanced scFc C 41BB CD2 zeta | 276 |
| MUC1-Panko5e5-enhanced scFc D 41BB CD2 zeta | 277 | GS linker | 278 | Construct of TSHR CAR | 279 |
| M FokI-1 | 280 | M FokI-2 | 281 | FokI WC | 282 |
| PSCA-CAR ScFv | 356 | CD8sp | 428 | Anti-TSHR-VL | 429 |
| 3*GGGGS linker | 278 | Anti-TSHR-VH | 430 | 4*GGGGS bispecific CAR linker | 431 |
| humanized-anti CD19-VH | 432 | humanized-anti CD19-VL | 433 | B7-H3 scFv 1 | 434 |
| B7-H3 scFv 2 | 435 | B7-H3 scFv 3 | 436 | Anti-18.2 (175)-VL | 437 |
| Anti-18.2 (175)-VH | 438 | Anti-18.2 (175) CAR Binding domain | 439 | | |

GGGGS (SEQ D NO: 278)

3*GGGGS is (GGGGS)₃ (SEQ ID NO:124) and 4*GGGGS is (GGGGS)₄ (SEQ ID NO:431)

CD8sp--Anti-tMUC1-VL--3*GGGGS linker--Anti-tMUC1-VH--4*GGGGS bispecific CAR linker--humanized-anti CD19-VH--3*GGGGS linker--humanized-anti CD19-VL (2501)

CD8sp--Anti-tMUC1-VL--3*GGGGS linker--Anti-tMUC1-VH--4*GGGGS bispecific CAR linker--humanized-anti CD19-VL--3*GGGGS linker--humanized-anti CD19-VH (2504)

CD8sp--humanized-anti CD19-VL--3*GGGGS linker--humanized-anti CD19-VH--4*GGGGS bispecific CAR linker--Anti-tMUC1-VL--3*GGGGS linker--Anti-tMUC1-VH CD8sp--humanized-anti CD19-VL--3*GGGGS linker--humanized-anti CD19-VH--4*GGGGS bispecific CAR linker--Anti-tMUC1-VH--3*GGGGS linker--Anti-tMUC1-VL Example 5. Double CAR reinfusion in vivo 8 NPG™ female mice were used, and they were 6 weeks old. On day 0, each of the mice was inoculated with 350×10$^4$ MCF-7 cells to establish an orthotopic tumor model. On day 35, each of the mice was infused with the corresponding cells as shown in Table 5.

TABLE 5

Experimental protocol

| Tumor Modeling | Infusion Dose | Infused Cells | ID of Mice |
|---|---|---|---|
| MCF-7 | 1000 × 10$^4$/ Per Mouse | NT | 827 |
| | | | 831 |
| | | 2407 (T cells expressing anti-tMUC1 CAR T cells, and the CAR binding domain comprises SEQ ID NO: 70) (CAR tMUC1-4-1BB) | 823 |
| | | | 830 |
| | | 1204 + 2407 (T cells expressing anti-CD19 and MUC1 CAR T cells, and the CAR of anti-CD19 comprises SEQ ID NO: 5) (CAR tMUC1-4-1BB/ CARCD19-4-1BB) | 822 |
| | | | 828 |
| | | N/A | 824 |
| | | | 829 |

On Day 42, about 150 ul of blood from each mouse was collected from the orbital venous plexus. On day 49, mice blood of the mice was collected from the orbital venous plexus about 150 ul each. Each peripheral blood was centrifuged to separate plasma, and plasma was used to measure cytokines. Peripheral blood-precipitated cells were stained with antibodies after being subjected to red-breaking treatment, followed by flow cytometry.

Percentages of T cells/mouse white blood cells in mouse peripheral blood were measured. Results are provided in FIGS. 16A-16B, 17A-17B, 18A-18B, 19A-19B, 20A-20B, 21A-21B, 22A-22B, and 23A-23B and Table 6.

FIGS. 16A-16B, 17A-17B, 18A-18B, and 19A-19B show flow cytometry results of human leukocytes/murine leukocytes in different groups. The cells were derived from all living cells after the mouse peripheral blood lysis. The horizontal axis represents the fluorescence intensity of hCD45 corresponding staining, and the vertical axis represents the fluorescence intensity of mCD45 corresponding staining.

FIGS. 20A-20B, 21A-21B, 22A-22B, and 23A-23B show flow cytometry results of T cells/human leukocytes. The cells were derived from human leukocyte hCD45 in FIGS. 16A-16B, 17A-17B, 18A-18B, and 19A-19B, the horizontal axis represents the fluorescence intensity of CD3 corresponding staining, and the vertical axis represents the fluorescence intensity of CD19 corresponding staining.

TABLE 6

| Leukocytes/murine leukocytes % | | | |
|---|---|---|---|
| Tumor Modeling | Infused Cells | ID of Mice | Leukocytes/murine leukocytes % |
| MCF-7 | NT | 827 | 0.54 |
| | | 831 | 4.9 |
| | 2407 | 823 | 37.12 |
| | | 830 | 12.16 |

TABLE 6-continued

| Leukocytes/murine leukocytes % | | | |
|---|---|---|---|
| Tumor Modeling | Infused Cells | ID of Mice | Leukocytes/murine leukocytes % |
| | 1204 + 2407 | 822 | 11.80 |
| | | 828 | 9.91 |
| | N/A | 824 | 0 |
| | | 829 | 0 |

As shown above, the proportion of T cells in the Mock group (N/A Infused Cells) was 0%, and the T cells in the NT group were less, which was in line with expectations. The proportion of T cells in group 2407 was greater than that in group 1204+2407, but further experiments were needed because the number of mice was small. Thus, double CAR cells can be activated like a single CAR cell.

Figures 24A, 24B:
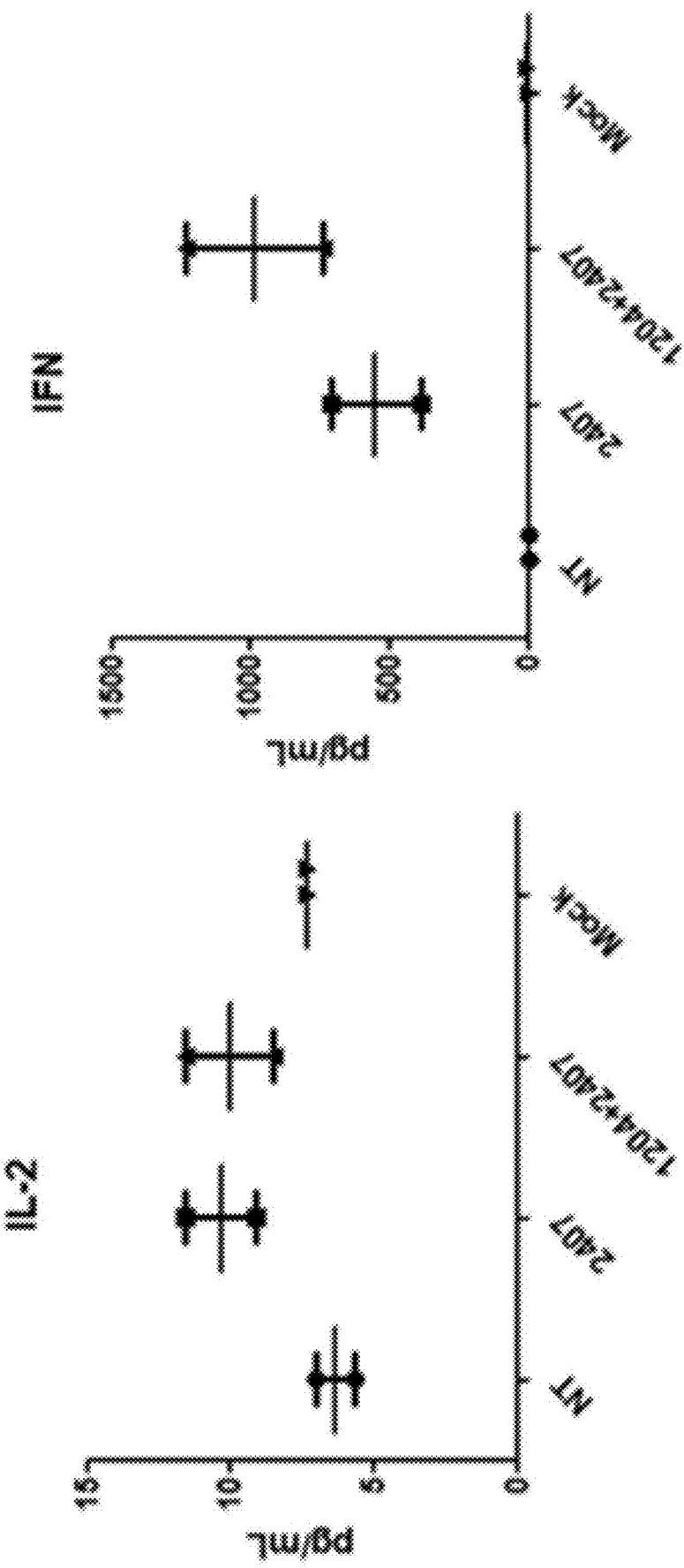
FIGS. 24A-24B show release of cytokines IL-2 and IFN-γ of each of the mice. Peripheral blood samples were obtained from the mice, and the supernatant were provided in Table 7.
Figures 25A, 25B:
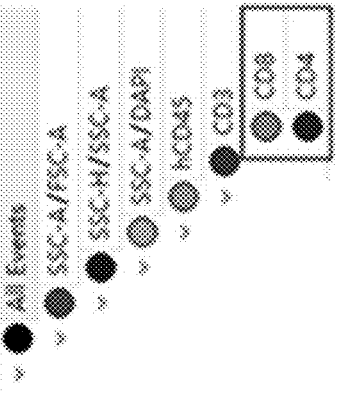
FIGS. 25A-25B, 26A-26B, 27A-27B, and 28A-28B proportion of CD8/CD4 in mouse peripheral blood T cells. The cells are derived from CD3 in FIGS. 20A-20B, 21A-21B, 22A-22B, and 23A-23B, the horizontal axis represents the fluorescence intensity of CD4 corresponding staining, and the vertical axis represents the fluorescence intensity of CD8 corresponding staining. Detailed results are provided in Table 14.
Figure 26B:
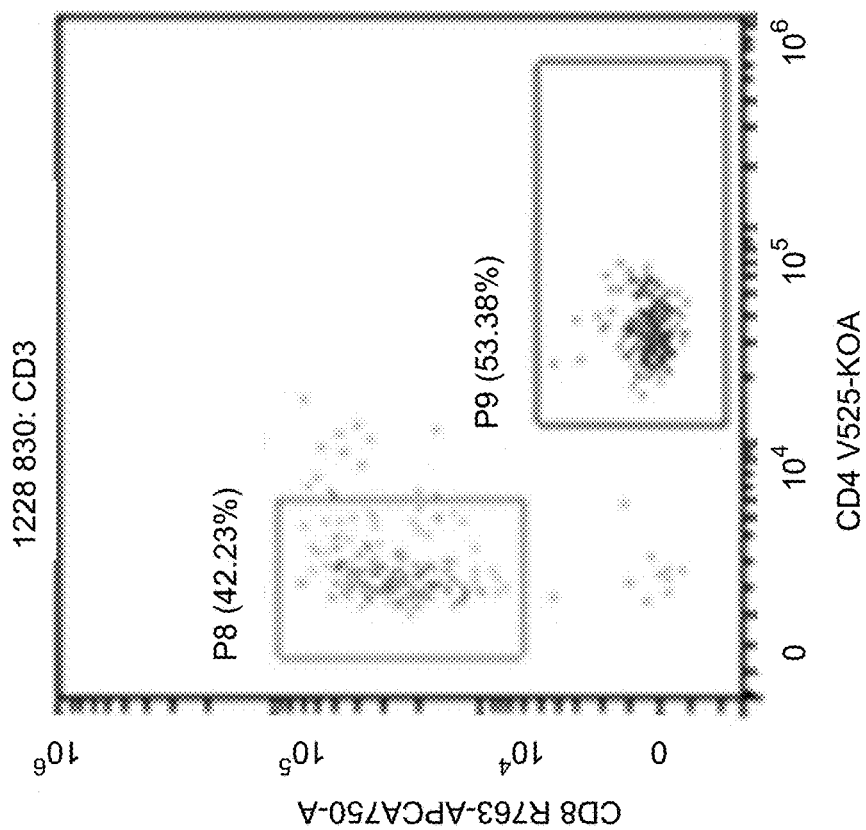
Figure 26A:
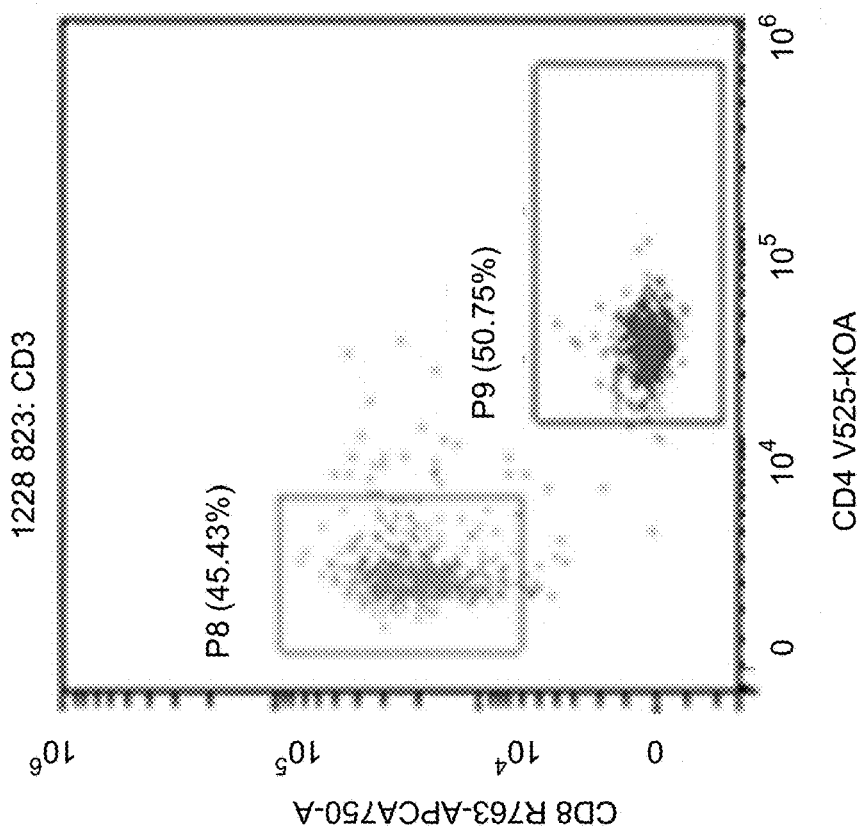
Figure 27B:
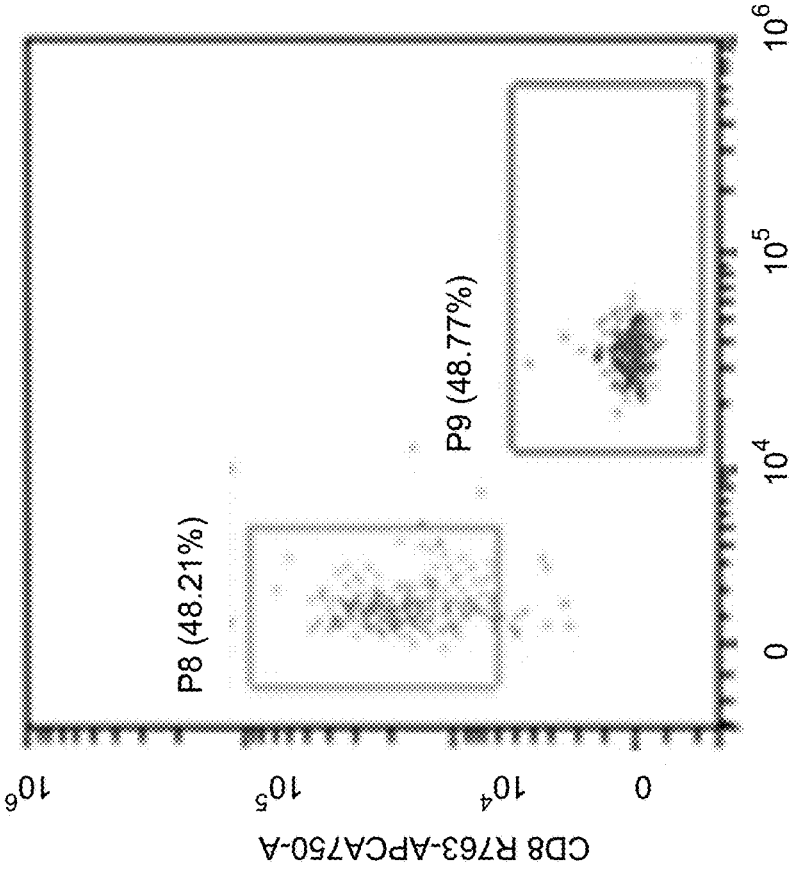
Figure 27A:
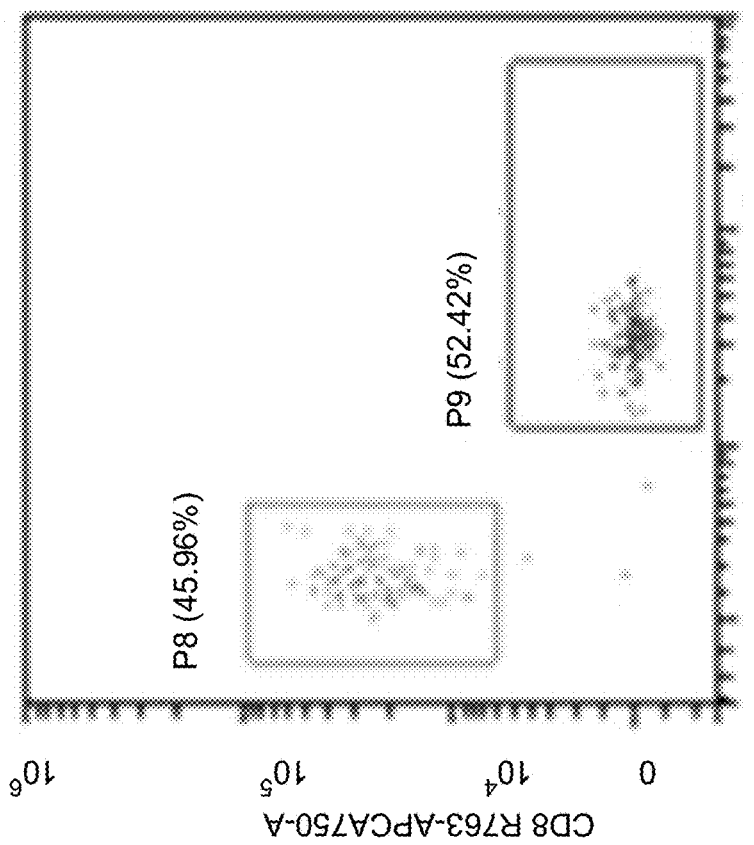
Figure 28A:
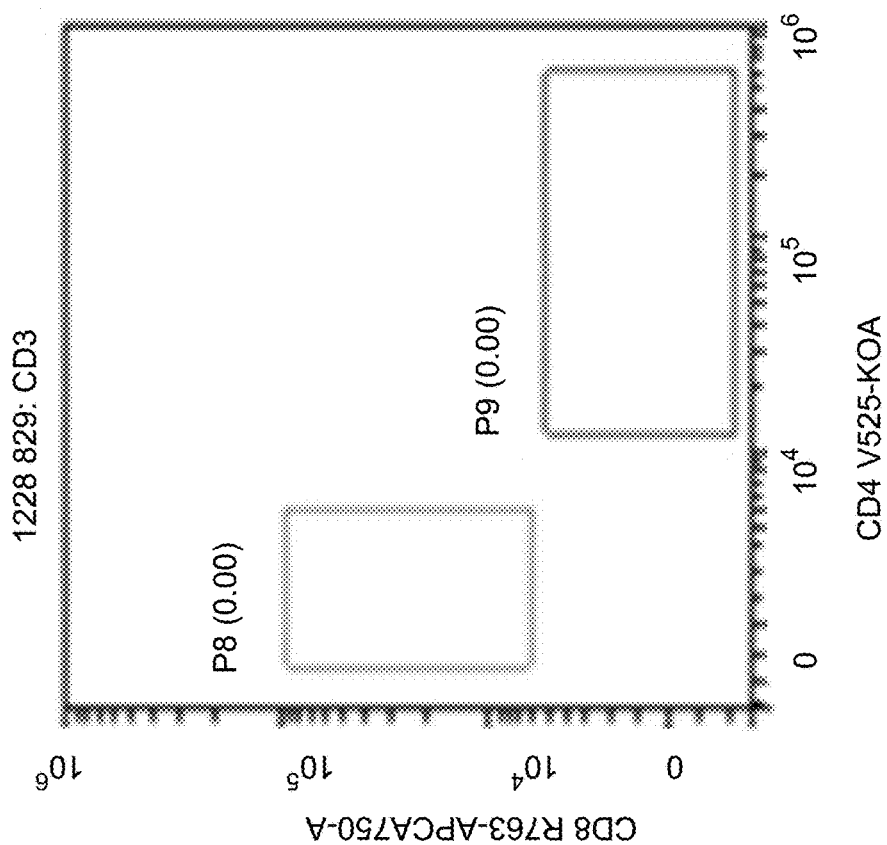
Figure 28B:
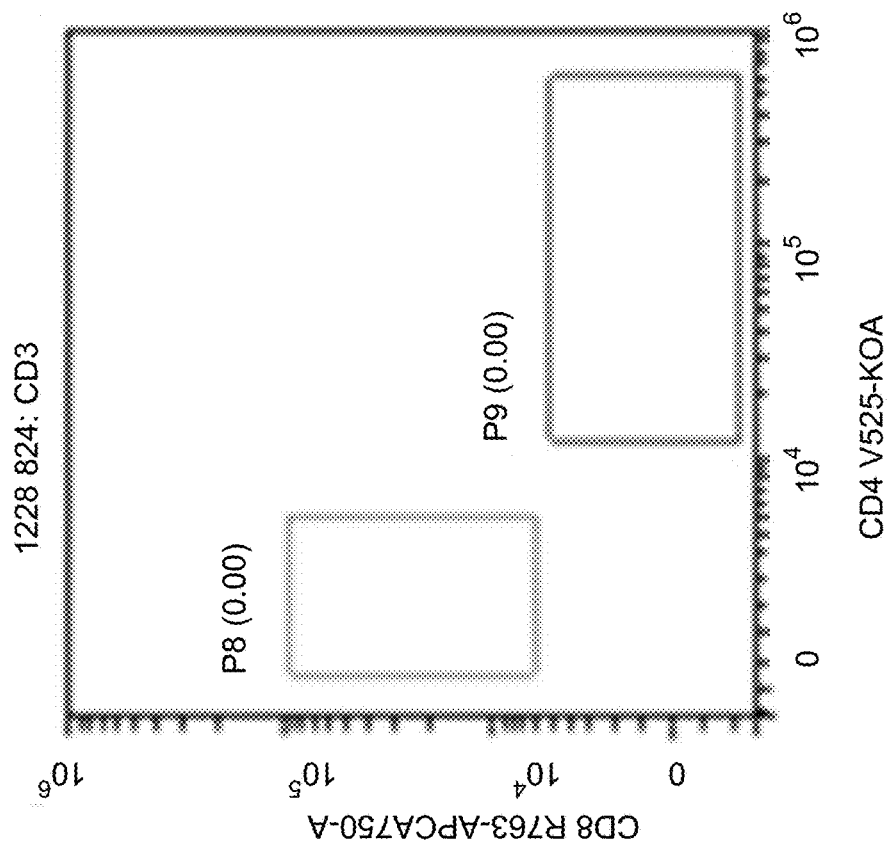

FIG. 24 shows release of cytokines IL-2 and IFN-γ of each of the mice. Peripheral blood samples were obtained from the mice, and the supernatant were provided as follows (unit: pg/mL) in Table 7.

TABLE 7

| Cytokine data | | | | |
|---|---|---|---|---|
| Tumor Modeling | Infused Cells | ID of Mice | IL-2 | IFN-γ |
| MCF-7 | NT | 827 | 7 | 1.04 |
| | | 831 | 5.64 | 0 |
| | 2407 | 823 | 9.13 | 385.9 |
| | | 830 | 11.57 | 711.68 |
| | 1204 + 2407 | 822 | 11.57 | 736.36 |
| | | 828 | 8.49 | 1235.00 |
| | N/A | 824 | 7.29 | 3.23 |
| | | 829 | 7.29 | 1.04 |

As shown above, the IL-2 release levels of IL-2:2407 and 1204+2407 were slightly higher than those of NT and Mock (N/A Infused Cells). The IFN-γ release in the NT group and the Mock group was basically 0, and the IFN-γ release in the 1204+2407 group was much higher than that in the 2407 group. Thus, double CAR cells can release cytokines like a single CAR cell.

FIGS. 25A-25B, 26A-26B, 27A-27B, and 28A-28B show proportion of CD8/CD4 in mouse peripheral blood T cells. The cells were derived from CD3 positive cells in FIGS. 20A-20B, 21A-21B, 22A-22B, and 23A-23B, and the horizontal axis represents the fluorescence intensity of CD4 corresponding staining, and the vertical axis represents the fluorescence intensity of CD8 corresponding staining. Detailed results are provided in Table 8.

TABLE 8

| CD8/CD4 in T Cells | | | |
|---|---|---|---|
| Tumor Modeling | Infused Cells | ID of Mice | CD8/CD4 in T Cells |
| MCF-7 | NT | 827 | 3.33:1 |
| | | 831 | 4:11:1 |
| | 2407 | 823 | 0.90:1 |
| | | 830 | 0.79:1 |
| | 1204 + 2407 | 822 | 0.88:1 |
| | | 828 | 0.99:1 |
| | N/A | 824 | N/A |
| | | 829 | N/A |

As shown above, the Mock group (N/A Infused Cells) has no CD8 and CD4. The 2407 group and the 1204+2407 group were basically flat, and the NT group CD8/CD4 ratio was much higher than the two groups.

17 NPG™ female mice were used, and they were 8 weeks old. After the animals arrived, they were sterilized and transferred to the animal room. The experimental animals were acclimatized for 7 days. The animals were observed in the cage daily during the adaptation period. After the end of the animal adaptation period, the animals were irradiated on the day before the experimental modeling. The irradiation dose was 1 Gy.

Mice were modeled on the second day after irradiation. MCF-7 cells were injected into the mammary fat pad of mice by in situ vaccination with a mammary fat pad to establish a tumor model. The day of modeling is Day 0.

TABLE 9

Mice modeling protocol

| Number of animals/gender | Modeling cell | Modeling method | Modeling cell mass |
|---|---|---|---|
| 17/F | MCF-7 | In situ inoculation of breast fat pad | 500 w/Mouse |

The modeled 17 mice were divided into 4 groups according to a random grouping as shown in Table 10.

TABLE 10

Experimental protocol

| Returning cells | Nalm6 stimulation | Number of animals |
|---|---|---|
| 2407 + 1204 (T cells expressing anti-CD19 and MUC1 CAR T cells) | NA | 4 |
| 2407 (T cells expressing anti-MUC1 CAR T cells) | NA | 5 |
| 2407 + 1204 (Nalm6 stimulation) | Stimulation of Nalm6 cells prior to cell reinfusion | 5 |
| NT | NA | 3 |

After modeling, volumetric measurements of mouse tumors were initiated when visible tumors were visible to the naked eye. Nalm6 cell stimulation was performed as follow. Five mice in the 2407+1204 (Nalm6 stimulation) group in Day 9 were injected with Nalm6 cells for stimulation. Nalm6 cells were injected into mice by tail vein injection using the protocol in Table 11.

TABLE 11

Experimental protocol

| Stimulating cell | Stimulating cell mass |
|---|---|
| Nalm6 | 50w/Mouse |

On day 10, each of the mice was infused (tail vein injection) with the corresponding cells as shown in Table 12.

TABLE 12

Experimental protocol

| Modeling cell | Return volume | Nalm6 stimulation | Animal number |
|---|---|---|---|
| 2407 + 1204 | 1000 w/Mouse | no | 921, 922, 923, 924 |
| 2407 | 1000 w/Mouse | no | 903, 904, 905, 906, 907 |
| 2407 + 1204 (Nalm6 stimulation) | 1000 w/Mouse | Yes | 934, 938, 939, 940, 958 |
| NT | 1000 w/Mouse | no | 908, 909, 910 |

Peripheral blood collection was performed on mice one week after cell reinfusion, and blood was collected through the orbital venous plexus. On day 17, the first blood collection was performed.

Peripheral blood was centrifuged to separate the plasma, and plasma was used to measure cytokines. Peripheral blood-precipitated cells were stained with antibodies after being subjected to red-breaking treatment, followed by flow cytometry. The data was analyzed and shown in FIGS. 29, 30, and 31A-31B (Peripheral blood flow data).

Figure 29:
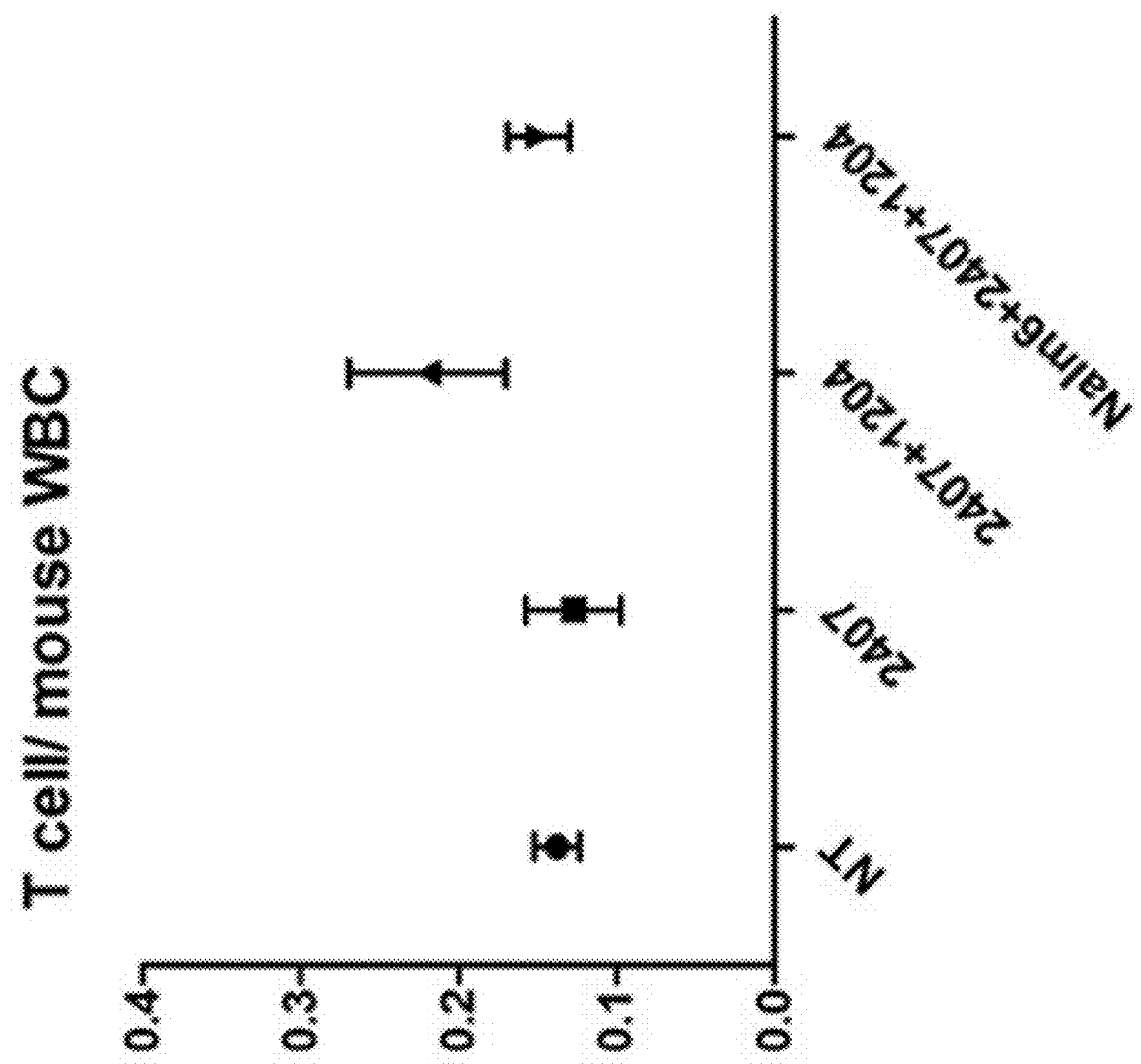
FIG. 29 shows results of T cell/mouse white blood cell (WBC). It can be seen from the statistics and the data in Table 13 that the ratios of white blood cells in the T cells/mouse of the NT group, the 2407 group, and the Nalm6+2407+1204 group are similar, and the ratios of the white blood cells of the 2407+1204 group to the other four groups of T cells/mouse is higher.

FIG. 29 shows results of T cell/mouse white blood cell. It can be seen from the statistics and the data in Table 13 that the percentage of T cell in white blood cells of the NT group, the 2407 group, and the Nalm6+2407+1204 group are similar, and the ratios of the white blood cells of the 2407+1204 group to the other four groups of T cells/mouse are higher.

TABLE 13

T cell/mouse white blood cell

| Modeling cell | Returning cells | Numbering | % T cell/mouse white blood cell |
|---|---|---|---|
| MCF-7 | NT | 908 | 13.58% |
| | | 909 | 11.41% |
| | | 910 | 16.35% |
| | 2407 | 903 | 20.63% |
| | | 904 | 8.60% |
| | | 905 | 6.33% |
| | | 906 | 8.66% |
| | | 907 | 19.43% |
| | 2407 + 1204 | 921 | 17.01% |
| | | 922 | 14.75% |
| | | 923 | 36.67% |
| | | 924 | 19.54% |
| | Nalm6 + 2407 + 1204 | 934 | 14.20% |
| | | 938 | 13.18% |
| | | 939 | 19.02% |
| | | 940 | 8.79% |
| | | 958 | 19.41% |

FIG. 30 shows results of CD8/CD4. It can be seen from the statistics data in Table 14 that there is no significant difference in the ratio of the four groups of CD8/CD4.

TABLE 14

Ratios of CD8/CD4

| Modeling cell | Returning cells | Numbering | CD8/CD4 |
|---|---|---|---|
| MCF-7 | NT | 908 | 8.25 |
| | | 909 | 8.48 |
| | | 910 | 7.41 |

TABLE 14-continued

Ratios of CD8/CD4

| Modeling cell | Returning cells | Numbering | CD8/CD4 |
|---|---|---|---|
| | 2407 | 903 | 8.12 |
| | | 904 | 7.35 |
| | | 905 | 7.51 |
| | | 906 | 10.33 |
| | | 907 | 9.01 |
| | 2407 + 1204 | 921 | 10.23 |
| | | 922 | 10.48 |
| | | 923 | 9.73 |
| | | 924 | 9.71 |
| | Nalm6 + 2407 + 1204 | 934 | 9.59 |
| | | 938 | 7.89 |
| | | 939 | 11.92 |
| | | 940 | 11.09 |
| | | 958 | 10.55 |

Figure 31B:
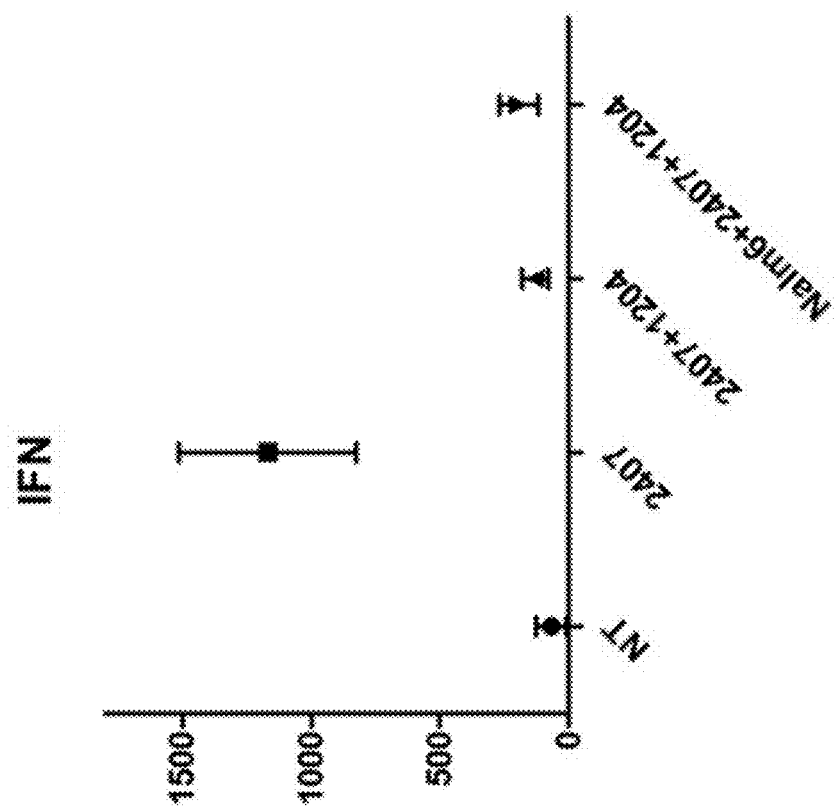
FIGS. 31A-31B show cytokine data from peripheral blood samples from mice and the supernatant.
Figure 31A:
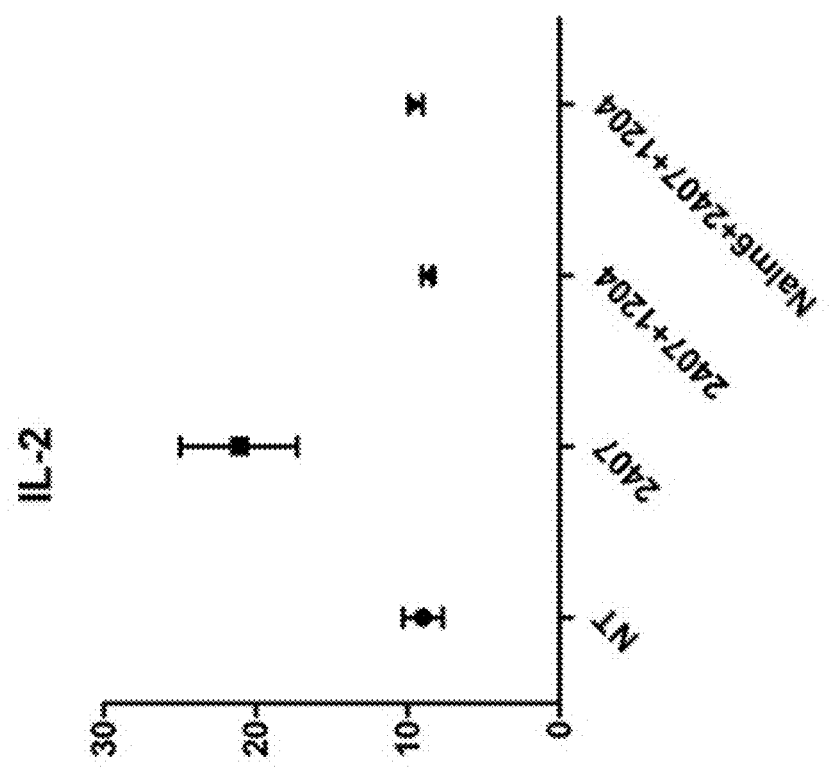

Peripheral blood samples from mice and the supernatant (unit: pg/mL) and cytokine data was analyzed (Table 15) and shown in FIGS. 31A-31B. It can be seen from the statistical graph and tabular data that the release of IL-2 in group 2407 is higher than that in the other three groups. Further, it can be seen from the statistics and tabular data that the release of IFN in the 2407 group was significantly higher than the other three groups. The amount of IFN released in the 2407+1204 group and the Nalm6+2407+1204 group was relatively close.

TABLE 15

Cytokine data

| Modeling cell | Returning cells | Numbering | IL-2 | IFN |
|---|---|---|---|---|
| MCF-7 | NT | 908 | 7.29 | 4.62 |
| | | 909 | 8.18 | 12.01 |
| | | 910 | 11.57 | 185.82 |
| | 2407 | 903 | 21.18 | 590.23 |
| | | 904 | 21.74 | 2033.41 |
| | | 905 | 19.57 | 1697.69 |
| | | 906 | 33.8 | 1348.12 |
| | | 907 | 9.46 | 182.51 |
| | 2407 + 1204 | 921 | 8.18 | 44.02 |
| | | 922 | 9.13 | 214.25 |
| | | 923 | 8.18 | 41.91 |
| | | 924 | 9.46 | 221.94 |
| | Nalm6 + 2407 + 1204 | 934 | 8.49 | 325.22 |
| | | 938 | 9.46 | 17.94 |
| | | 939 | 9.13 | 54.42 |
| | | 940 | 11.2 | 406.14 |
| | | 958 | 9.13 | 166.75 |

Figure 32:
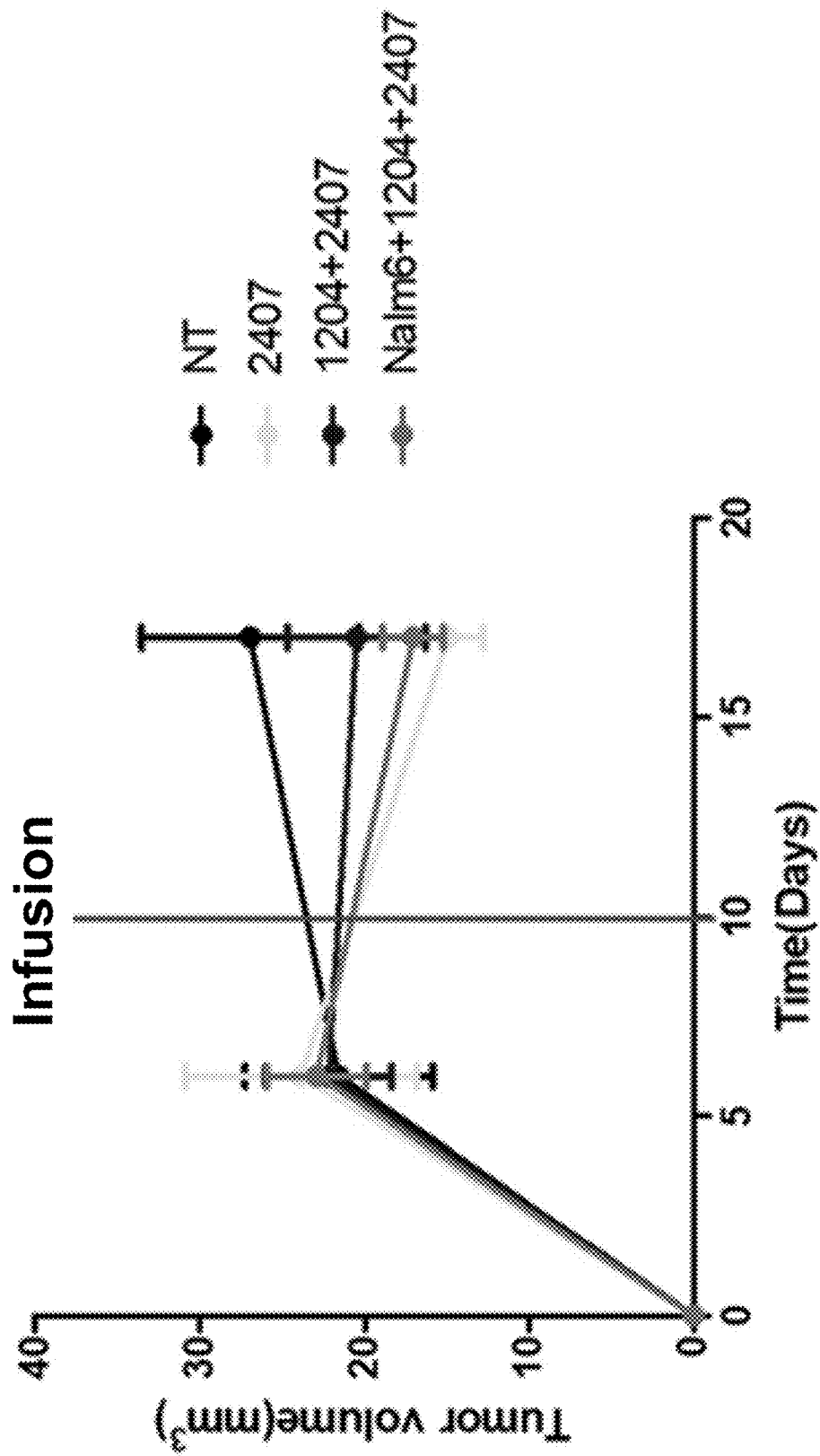
FIG. 32 shows tumor volumes change in mice in response to infusion with different cell groups.
Figures 34A, 34B, 34C:
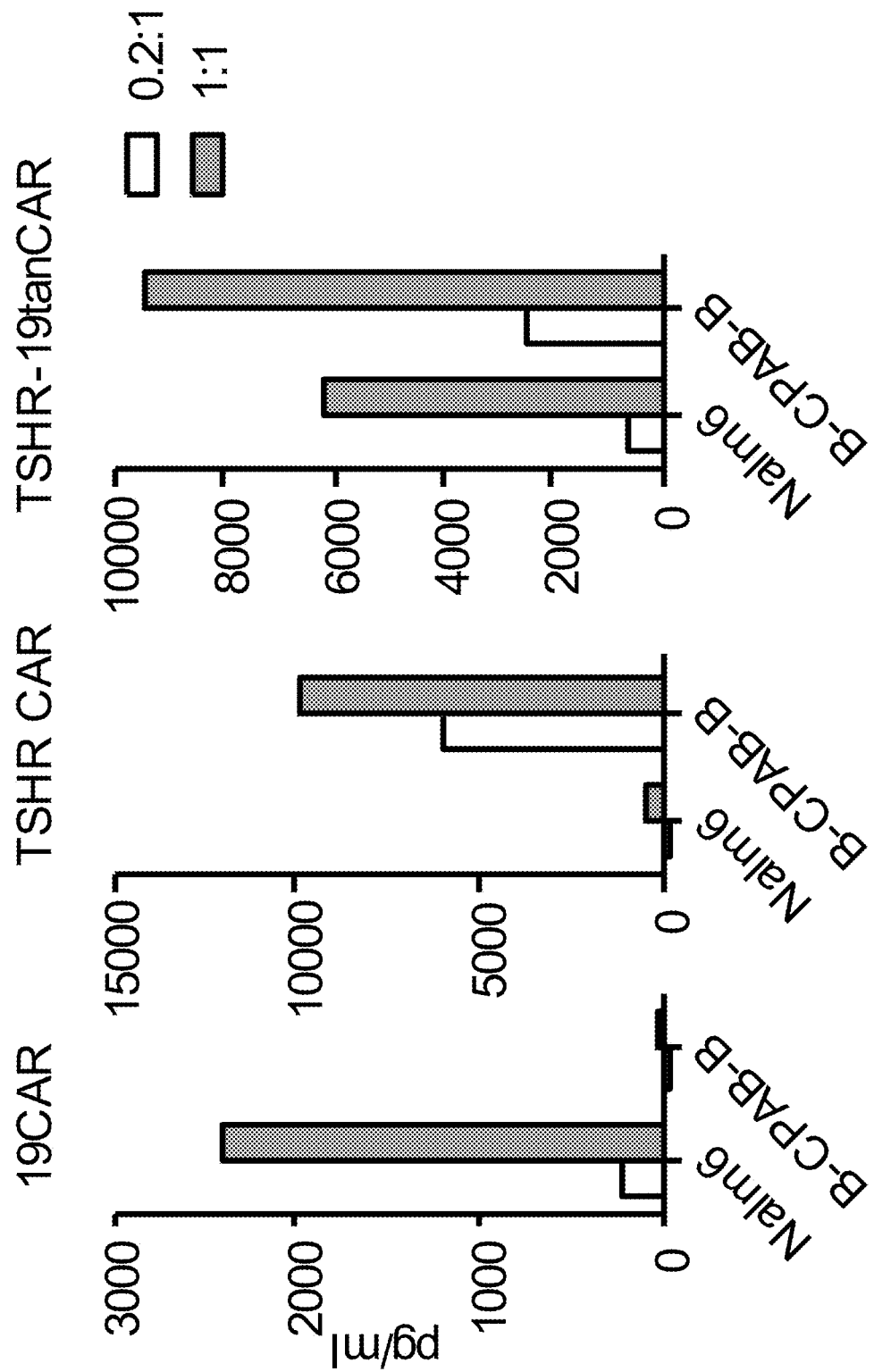
FIGS. 34A-34C show a cytokine release assay of T cells expressing a bispecific CAR.

FIG. 32 shows tumor volumes change in mice in response to infusion with different cell groups. The tumor volumes in different mice were measured (unit: mm3, volume formula according to V=long diameter*short diameter*short diameter*0.5) in certain time periods after the infusion of the various cells. results are shown in the figure. It can be seen from the above figure that the tumor volume of the 2407+1204 group remained basically unchanged after the reinfusion, and the tumor volume was reduced in the Nalm6+2407+1204 group and the 2407 group, and the tumor volume of the NT group increased. Thus, both double CAR and single CAR have similar anti-tumor functions.

Example 6. Bispecific CARs

Figure 36:
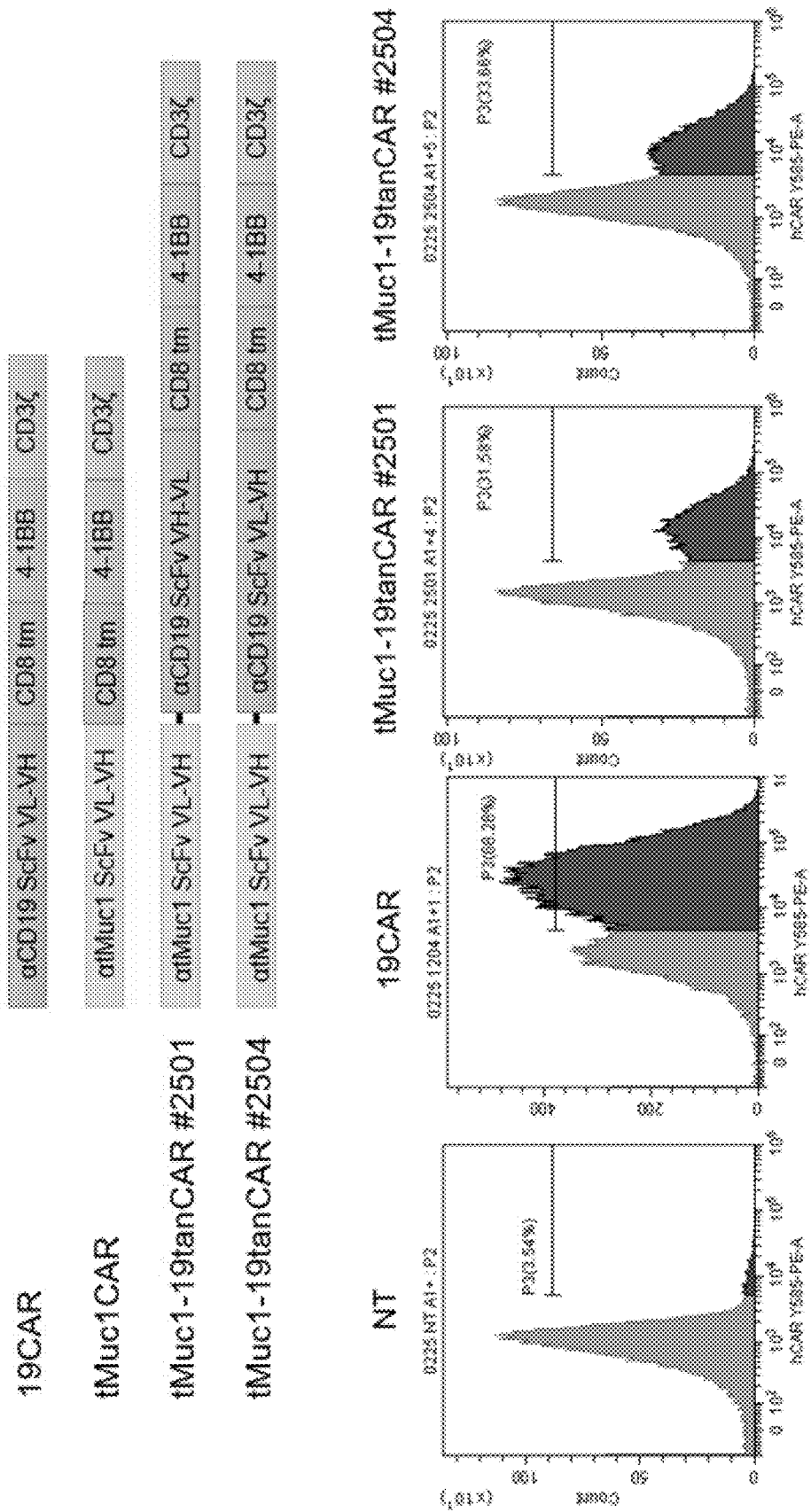
FIG. 36 shows another design of bispecific CAR.
Figure 37:
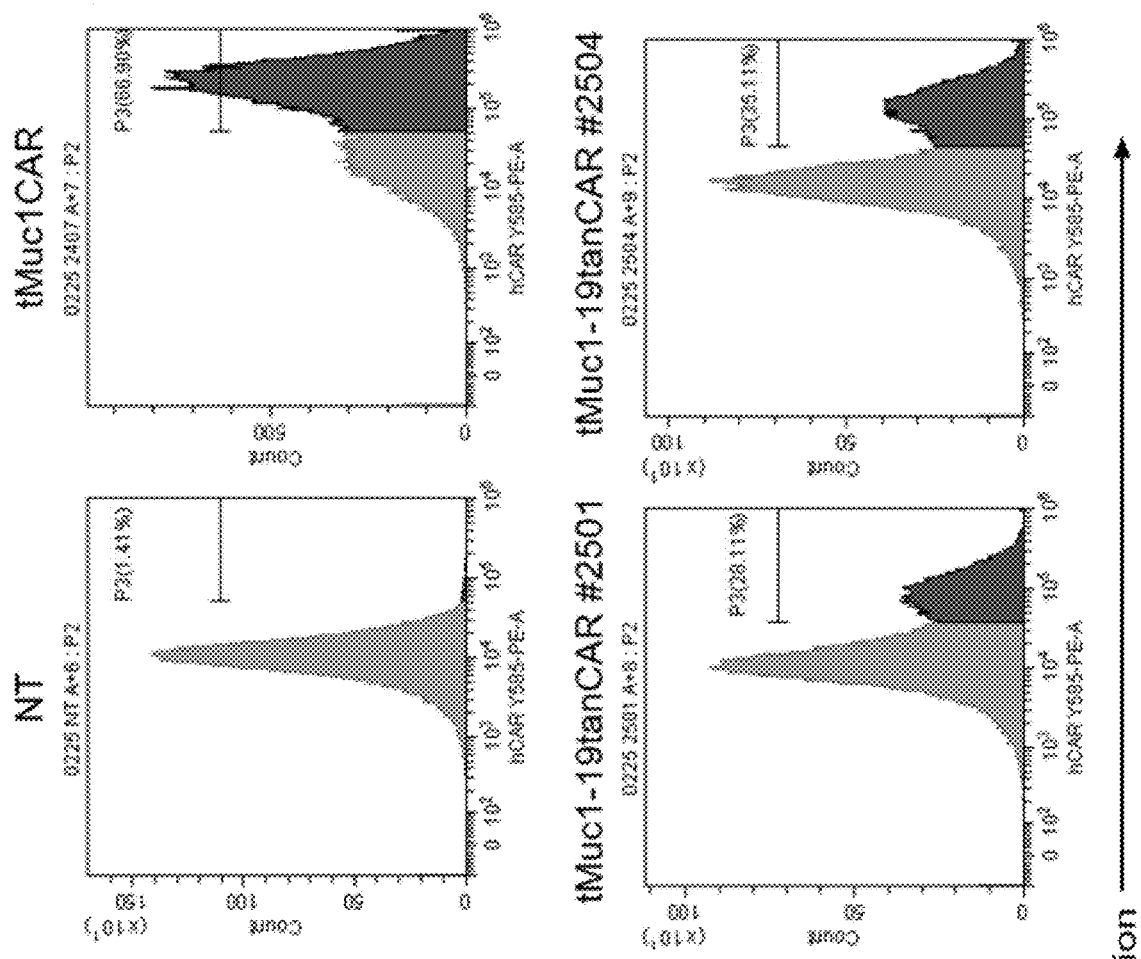
FIG. 37 shows an expression assay of the bispecific CAR in FIG. 36.
Figure 39A:
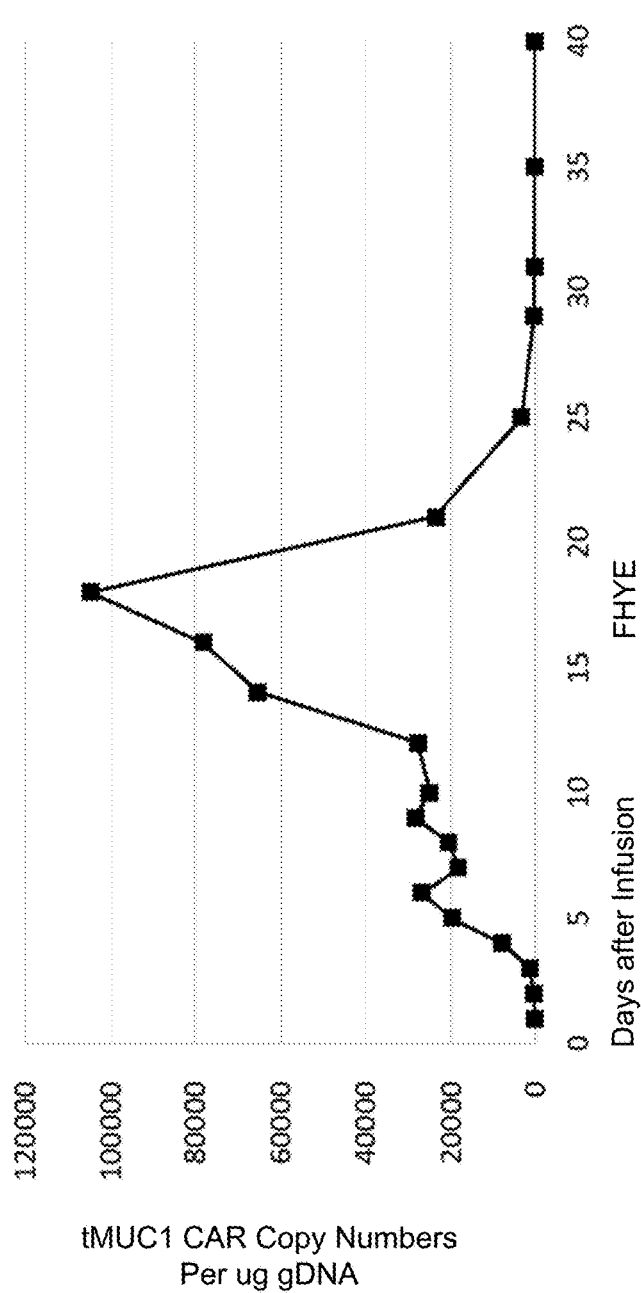
FIGS. 39A-39B show CAR copy number changes of patients in response to infusion of T cells expressing tMUC1 CAR and CD19 CAR.
Figure 39B:
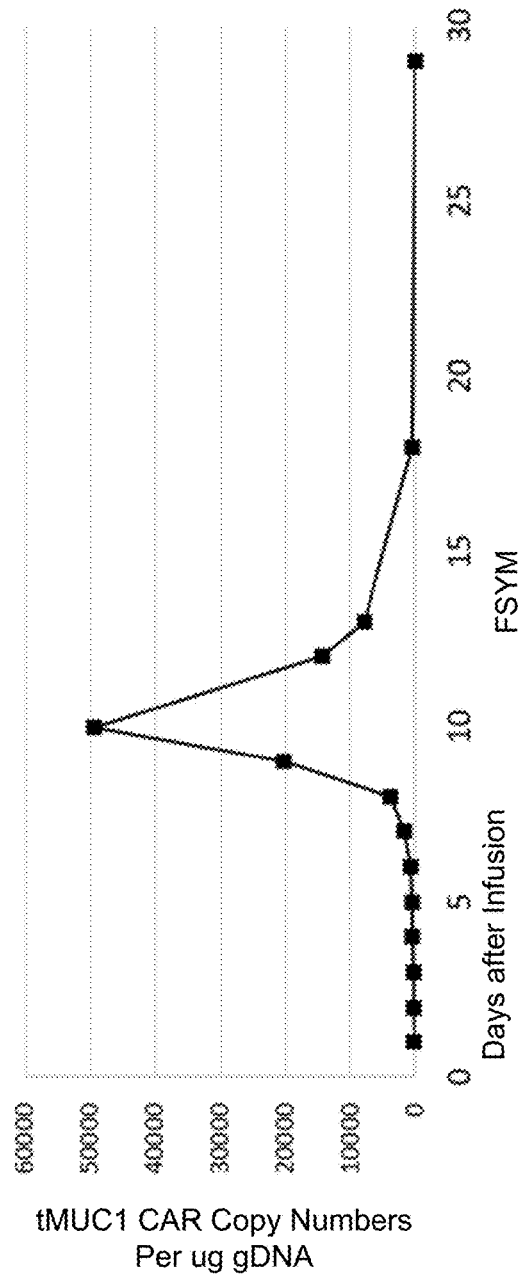

On Day 0, peripheral blood of healthy volunteers was drawn, sorted to collect CD3+ T cells, and added CD3/CD28 Dynabeads in a 1:1 ratio to the collected cells. On Day1, T cells were transfected with vectors including CD19 CAR (MOI=15; the binding domain of the CAR being SEQ ID NO: 5) and vectors including TSHRCAR (MOI=92; the binding domain of the CAR being SEQ ID NO: 8), and vectors including TSHR-CD19 bispecific CAR (MOI=92; the binding domain of the CAR being SEQ ID NO: 435). More sequence information is provided in FIG. 33 and Table 4. On Day 2, culture media were changed, the lentivirus was removed, and the cells were resuspended in a fresh medium. On Day 5, flow detection of CAR expression was performed. Various expression rates were observed (Anti-19CAR 17.45%, Anti-TSHRCAR 76.84%, and Anti-TSHR-& Anti19 bispecific CAR 20.59%). Also, on Day 0, peripheral blood of healthy volunteers was extracted, sorted to collect CD3+ T cells, and added CD3/CD28 Dynabeads in a 1:1 ratio to the collected cells. On Day1, T cells were transfected with vectors including 19CAR (MOI=2; the binding domain of the CAR being SEQ ID NO: 5) and vectors including tMUC1 CAR (MOI=30; the binding domain of the CAR being SEQ ID NO: 70), and vectors including tMUC1-CD19 bispecific CAR (MOI=95; the binding domain of the CAR being SEQ ID NO: 437), and vectors including CLDN18.2-CD19 bispecific CAR (MOI=180, the binding domain of the CAR being SEQ ID No: 439). More sequence information is provided in FIGS. 36, 43, as well as 44 and Table 4. On Day 2, culture media were changed, the lentivirus was removed, and the cells were resuspended in a fresh medium. On Day 5, flow detection of CAR expression was performed. Various expression rates were observed (Anti-19CAR 68.28%, Anti-TMUC1CAR 31.58%, and Anti-TMUC1-& Anti19 bispecific CAR 28.11% and 35.11%).

As shown in FIGS. 34A-34C, 0.2 or $1\times10^4$ CAR T cells and 104 Nalm6 or B-CPAB-B tumor cells were co-cultured for 24 h, and supernatant was then collected. IFNγ release was detected. Nalm6 was a CD19-positive tumor cell, and B-CPAB-B was a TSHR positive tumor cell. As shown in the left panel of FIGS. 34A-34C Anti-CD19 CAR T cells released more IFNγ in response to Nalm6 as compared to that released in response to B-CPAB-B. As shown in the middle panel, Anti-TSHR CAR T cells released more IFNγ in response to B-CPAB-B as compared to that released in response to Nalm6. As shown in the right panel, bispecific CAR T cells released significant amount of IFNγ in response to each of Nalm6 and B-CPAB-B. These results indicated that bispecific CAR T cells can be stimulated by both CD19-positive or TSHR-positive cells.

Figure 35:
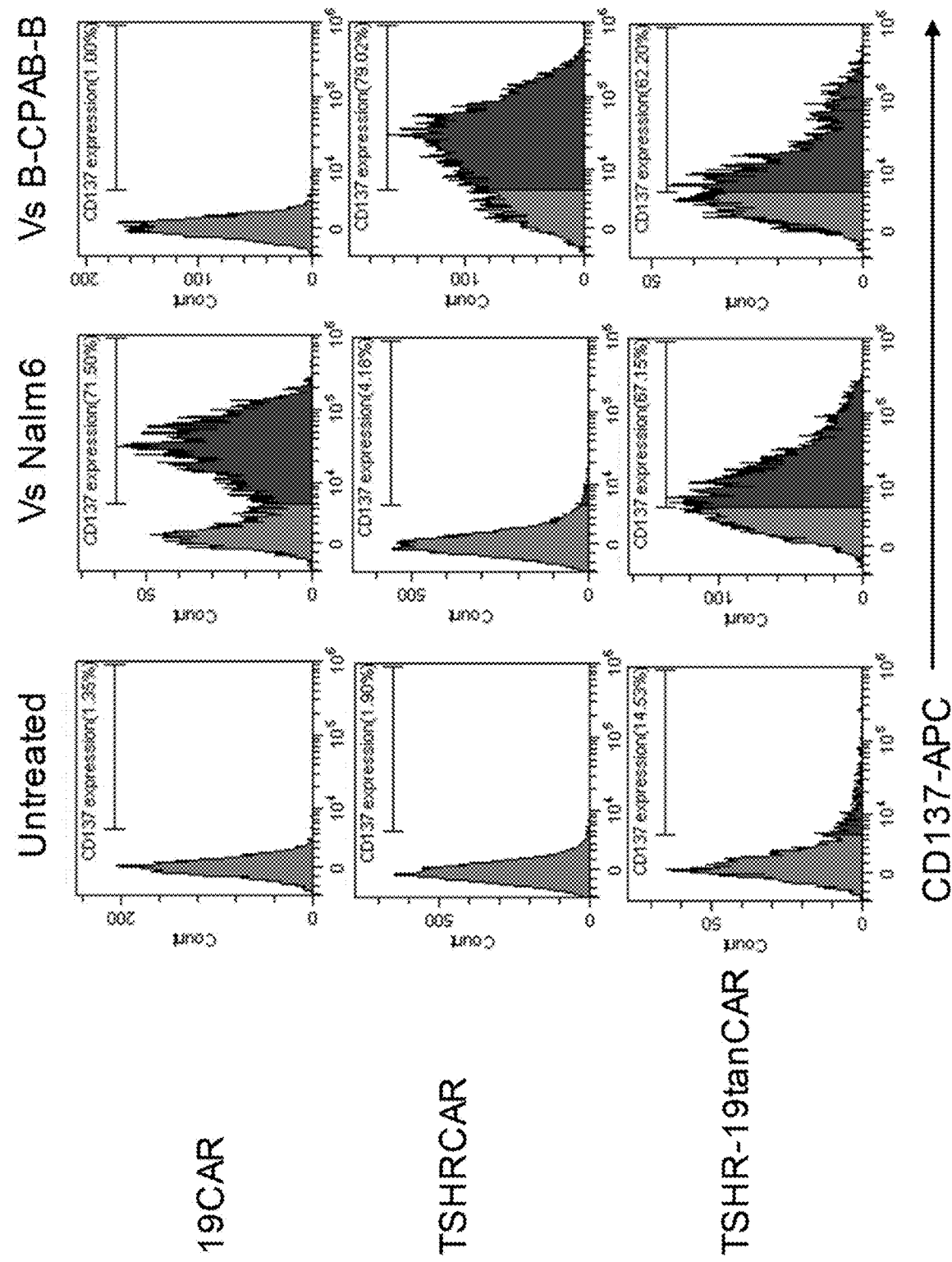
FIG. 35 shows a co-culturing assay of T cells expressing a bispecific CAR.

$10^5$ CAR T cells and $10^5$ Nalm6 or B-CPAB-B tumor cells were co-cultured for 24 hours, and the CD137 expression of CAR T CD8 positive cells was then detected by flow cytometry. The left panel of FIG. 35 showed CD137 expression of CAR T cells not co-cultured with tumor cells, while the middle and right showed CD137 expression of CAR T cells co-cultured with Nalm6 or B-CPAB-B. The results demonstrated that bispecific CAR T (TSHR-19 bispecific CAR) were activated by both Nalm6 and B-CPAB-B. Similar cytokine release assays were performed and showed that bispecific CAR T (CLDN18.2-19 bispecific CAR) cells were activated by both Nalm6 and cells expressing CLDN18.2, Example 7. CAR T Cell Expansion in Patients Clinical studies were designed to assess the safety and efficacy of infusing autologous T cells modified to express several solid tumor markers specific CAR/4-1BB/CD3-ζ into patients. On the first arm of the studies, patients received solid tumor marker-specific CAR T cells only. The solid tumor marker included TSHR and tMUC1. On the second arm, patients received CAR T cells directed to CD19 and tMUC1. T cells of the patients were obtained, modified, and infused to the patients. T cell responses of patients from the first and second arms were measured and compared using the following protocols, which were approved by the hospitals where the trials were conducted. All patients were provided with written informed consent. Information regarding these patients are provide below in Table 16 (SD: stable disease; PD: progressive disease; PR: partial remission; CR: complete remission; NR, no response).

TABLE 16

Figure 42:
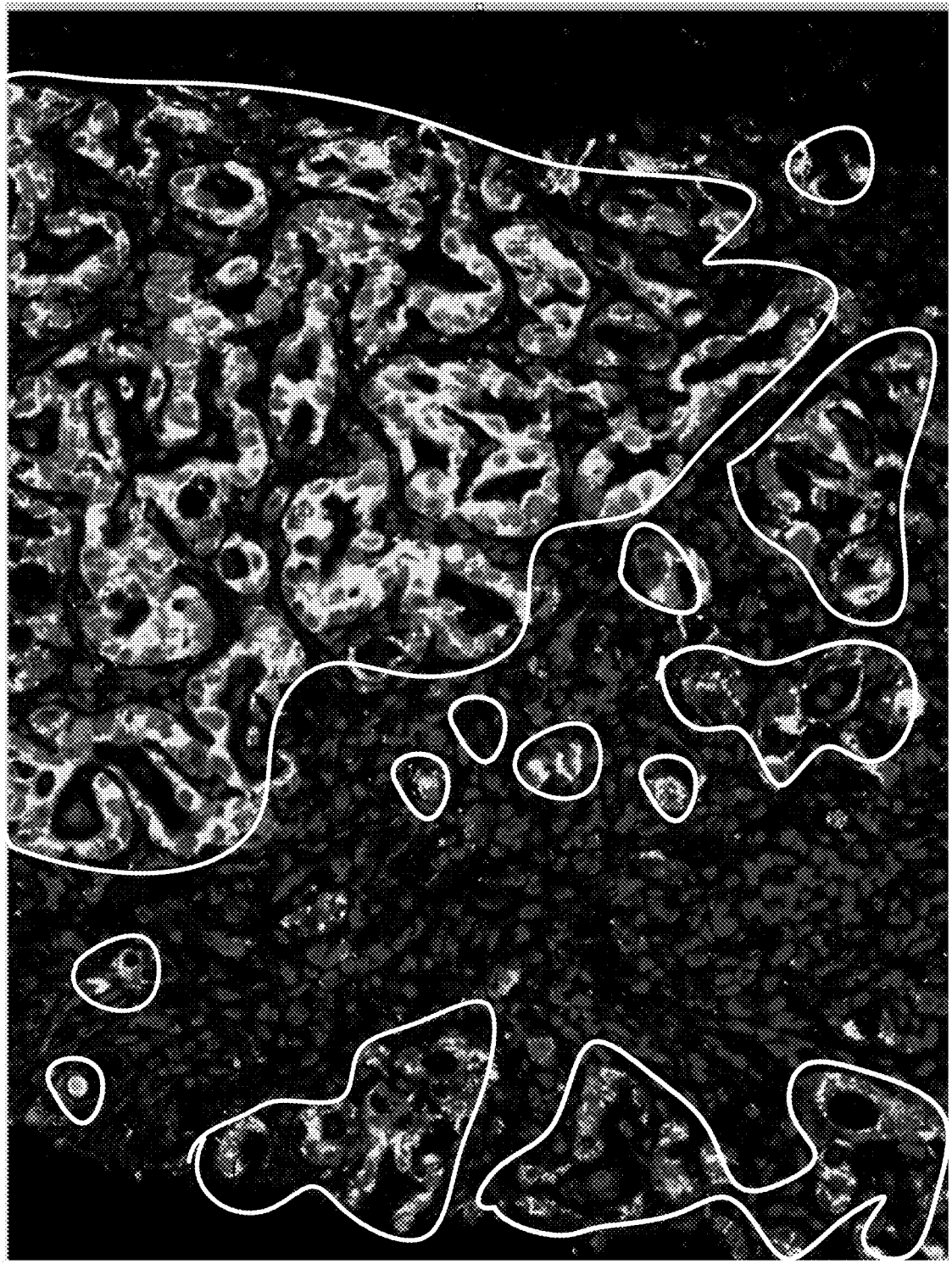
FIG. 42 shows infiltration of lymphocytes and neutrophils was observed in tumor biopsy from FHYE on day 26. No significant lymphocytes infiltration was observed in tumor biopsy before CAR T cell infusion. Slices of the tumor biopsy were stained with antibodies again tMUC1 CAR showing areas of cell expressing tMUC1 CAR (bright spot areas surrounded by with white lines).
Figure 45B:
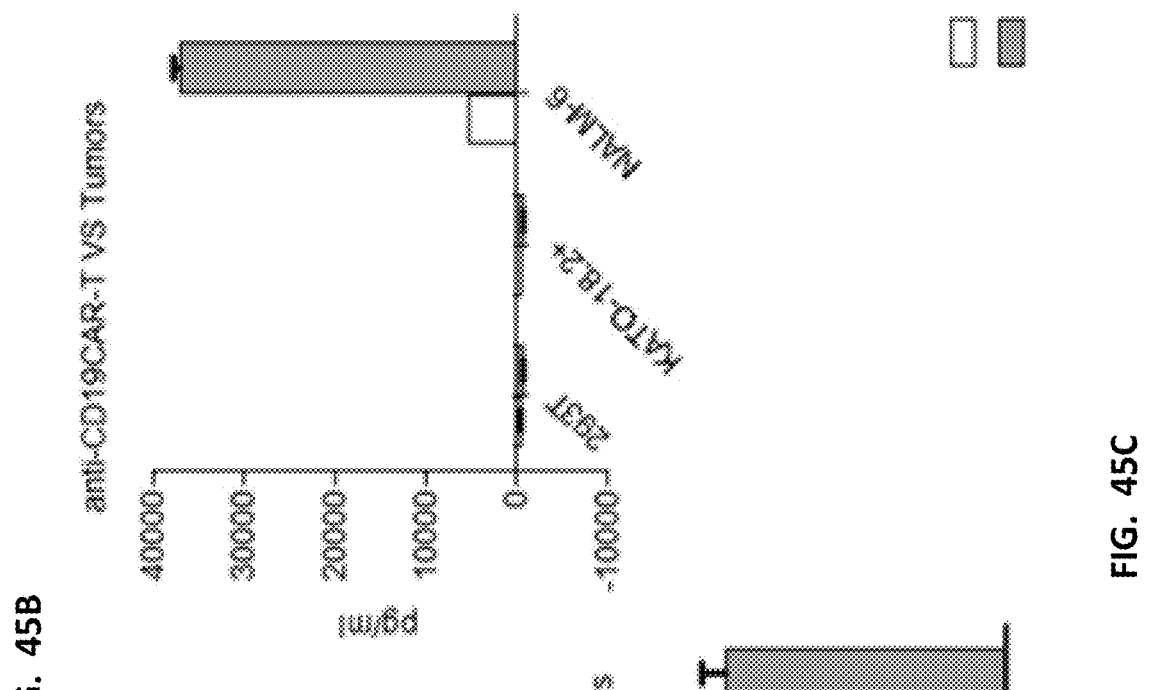
FIGS. 45A-45C show results of cytokine release of co-culturing CAR T cells and tumor cells. The experiment was carried out by co-culturing with 0.2 or $1\times10^4$ CAR T cells and $1\times10^4$ 293T or KATO III-18.2+ or Nalm-6 cells, and the supernatant was collected after 24H to detect IFN-γ. Nalm-6 is a CD19 T cell; KATO III-18.2+ is a cell that overexpresses KLDN18.2; and 293T is a double-negative cell. As shown, 18.2 CAR T showed significant IFN-γ release when co-cultured with KATOIII-18.2+ cells, indicating that KATOIII-18.2+ can be recognized by 18.2 CAR T cells and release IFN-γ to kill target cells; Nalm-6 was also recognized by CD19CAR T cells and release IFN-γ to kill target cells; 18.2-19 bispecific CAR had significant IFN-γ release when co-cultured with KATOIII-18.2+ and Nalm-6. In addition, Nalm-6 could not stimulate the release of IFN-γ from 18.2 CAR T cells, and CD19 CAR T cells could not stimulate the release of IFN-γ by KATO III-18.2+, indicating that both CAR T cells are specific. In conclusion, 18.1-CD19 CAR T cells can specifically recognize 18.2 and CD19-positive target cells, and release IFN-γ to kill target cells.
Figure 45C:
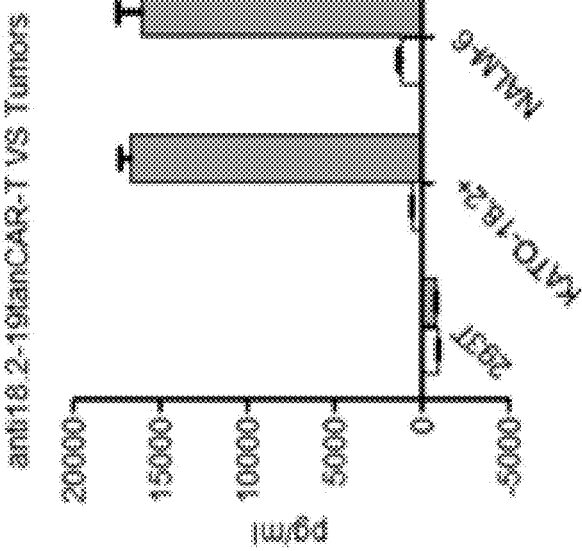
Figure 45A:
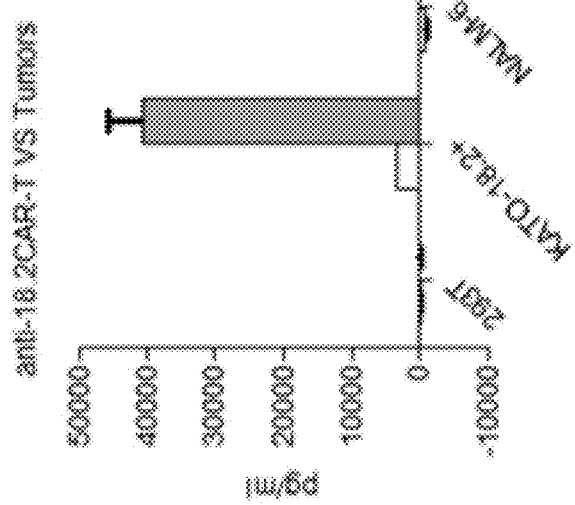
Figure 46:
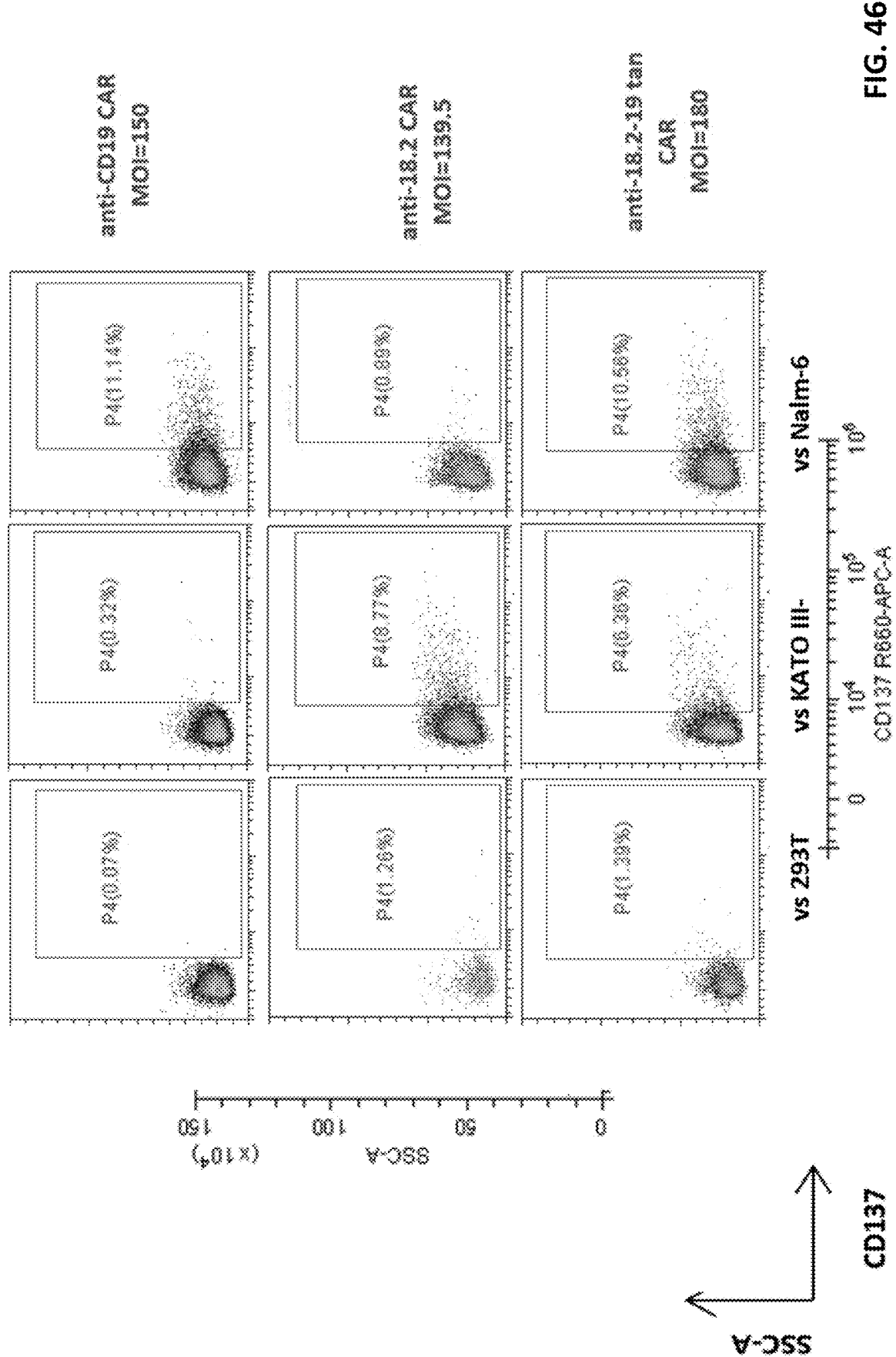
FIG. 46 shows flow cytometry results depicting CD137 expression for co-culturing of CAR T cells and tumor cells. $1\times10^4$ CAR T cells were co-cultured with $10\times10^4$ 293T-WT or KATOIII-18.2+ or Nalm-6 cells, and CD137 expression of CAR T CD8+ cells was detected by flow cytometry after 48 Hours. The left column is the CD137 expression of CAR T cells co-cultured with 293T, and the CD19 CAR expression is absent in the CD19 CAR group, the 18.2 CAR group, and the 18.2-19 tan CAR group. It can be seen that the 293T has no specific antigen expression and cannot activate CAR T cells. In the middle column, CAR T cells were co-cultured with KATO III-18.2+ cells with high expression of 18.2 protein. The expression of CD137 in the 18.2 CAR group was 8.77%, and the expression of CD137 in the 18.2-19 bispecific CAR group was 6.36%. The expression of CD137 was not observed in the CD19 CAR group. 18.2-CAR T and 18.2-CD19 bispecific CAR T recognize and activate the 18.2 protein in KATOIII-18.2+; CD19 CAR T did not. The right column is a co-culture of CAR T cells with Nalm-6 cells, which are CD19+ cells that are specifically recognized and activated by 19 CAR T cells. The results showed that the expression of CD137 in the 19 CAR group was 11.14%, the expression of CD137 in the 18.2-19 bispecific CAR group was 10.55%, and the expression in the 18.2 CAR group was not. CD19 CAR and 18.2-CD19 bispecific CAR can be activated by Nalm-6, while 18.2 CAR failed. In conclusion, it was demonstrated that 18.2-CD19 bispecific CAR T cells can specifically recognize 18.2 antigen and CD19 antigen. CD137 is a marker protein for the activation of T cells, and the level of CD137 up-regulation of CAR T cells after co-culture with CAR T cells and substrate target cells can be used to determine whether CAR T cells are activated.

| P's ID | Age | Cancer | Target Marker | Infusion CART/kg | CAR T cell types Percentage before infusion | Safety or Adverse reaction (AR) | Efficacy |
|---|---|---|---|---|---|---|---|
| FLXY | 56 | Breast cancer | MUC1 | ①$1 \times 10^6$ (2018.1.5) ②$1.24 \times 10^6$ (2018.1.29) ③$0.966 \times 10^7$ (2018.3.7) Concentration climbing test | N/A | CRS 1 Temperature 39.4° | PD |
| MFPH | 66 | Pancreatic cancer | MUC1 | ①$1.28 \times 10^6$ (2018.4.5) ②$1.29 \times 10^7$ (2018.6.15) Concentration climbing test | N/A | CRS 1 Temperature 39° | NR |
| MBIXI | 50 | Thyroid cancer | TSHR | $0.11 \times 10^6$ | N/A | No AR | NR |
| FHYE | 64 | Pancreatic cancer | MUC1 + CD19 | $1.18 \times 10^6$ | MUC1 CAR T cells /CD3+ = 50% CD19 CAR T cells /CD3+ = 15% MUC1&CD19 CAR T cells/CD3+ = 6.8% | CRS 1-2 Neurotoxicity 2 | PD |
| FSYM | 48 | Breast cancer | MUC1 + CD19 + dnPD1 | $1.03 \times 10^6$ | N/A | CRS 1: Temperature 40° | PR in one month or likely Pseudo-progression in two Month (See FIG. 42 showing lymphocytes and neutrophils infiltration in the patient) |

Manufacturing of CAR T Cells

PBMCs were obtained from patients. Various lentiviral vectors were generated and then transfected to the T cells, which were further cultured for several days before the co-cultivation assay. More information may be found in Table 17 below. Techniques related to cell cultures, construction of cytotoxic T-lymphocyte assay may be found in "Control of large, established tumor xenografts with genetically retargeted human T cells containing CD28 and CD137 domains," PNAS, Mar. 3, 2009, vol. 106 no. 9, 3360-3365, which is incorporated herein by reference in its entirety.

TABLE 17

| P's ID | Vectors and MOI | Infusion Methods | Pre-treatment |
|---|---|---|---|
| FLXY | MUC1-CAR (scFv of the CAR is SEQ ID NO: 70): 30:1 | Fresh (first infusion) and Cryopreserved (second infusion) cells | cyclophosphamide 1.5 grams/m2 in −3 days |
| MFPH | MUC1-CAR (scFv of the CAR is SEQ ID NO: 70): 30:1 | Fresh cells | No |

TABLE 17-continued

| P's ID | Vectors and MOI | Infusion Methods | Pre-treatment |
|---|---|---|---|
| MBIXI | TSHR-CAR (scFv of the CAR is SEQ ID NO: 8): 100:1 | Fresh cells | FC regimen at −5 to −3 days (cyclophosphamide 500 mg/m2, fludarabine 30 mg/m2) |

TABLE 17-continued

| P's ID | Vectors and MOI | Infusion Methods | Pre-treatment |
|---|---|---|---|
| FHYE | MUC1-CAR (scFv of the CAR is SEQ ID NO: 70): 19:1 hCD19-CAR (scFv of the CAR is SEQ ID 5): 5:1 | Fresh cells | FC regimen at −5 to −3 days (cyclophosphamide 500 mg/m2, fludarabine 30 mg/m2) |
| FSYM | MUC1-CAR/Dominant Negative PD-1 (scFv of the CAR is SEQ ID NO: 70 and 89): 18:1 hCD19-CAR (scFv of the CAR is SEQ ID 5): 5:1 | Fresh cells | No |

Several methods were used to generate CAR T cells. For FLXY, MFPH, and MIBIX1, CD3+ cells were obtained from PBMCs and were cultured using X-vivo 15 medium containing IL-2. For example, CD3+ cells may be obtained using antibody kits including CD14, CD15, CD16, CD19, CD34, CD36, CD56, CD123, and CD235a to remove undesired cells. The CD3+ cells were activated using CD3/CD28 Dynabeads and then sampled as well counted before infection. The number of cells to be infected was obtained. The cell number of Group 1 was $6 \times 10^7$, and the cell number of Group 2 was $7 \times 10^7$. The number of corresponding carriers and the volume of the carrier were calculated according to the required carrier MOI (See Table 17). For FHYE and FSYM, PBMCs were cultured using TEXMACS culture containing IL-2. CD4 and CD8 magnetic beads were used to sort and select T cells in the PBMCs. The appropriate starting culture amount was selected and Transact activator was used to activate T cells. MACS® GMP T Cell TransAct™ includes a colloidal polymeric nanomatrix covalently attached to humanized recombinant agonists against human CD3 and CD28. Due to the nanomatrix MACS GMP T Cell TransAct can be sterile filtered and excess reagent can be removed by centrifugation and following conventional supernatant replacement or simply by medium wash. This reagent is suitable for use in automated culture systems, such as the CliniMACS Prodigy® Instrument. The cell number of Group 3 was $9.1 \times 10^7$. The number of corresponding carriers and the volume of the carrier were calculated according to the required carrier MOI (See Table 17).

Infusion of Cells and Cell Expansion

For fresh cells, after removing the magnetic beads, the transduced cells were centrifuged or replaced with a solution of 95% compound electrolyte injection of 5% human albumin, loaded into a return bag, and transported at 15-25° C. after sealing. Fresh preparations are returned directly. For Cryopreserved cells, the transduced cells were transfer to media including a compound electrolyte injection of 33.75% human albumin 25% dextran 40 glucose injection 33.75% DMSO 7.5%. The cell suspension was loaded into a cryopreservation bag and then the procedure was cooled to −90° C. and transferred to a gas phase liquid nitrogen tank for storage. The reconstitution of the frozen preparations was completed within 30 minutes after resuscitation. Peripheral blood mononuclear cells (PBMCs) were obtained from patients by leukapheresis for CAR T cell preparation, and the first day of CAR T infusion was set as study day 0.

Patients were given a conditioning treatment for lymphodepletion for cells including CD19 CAR. Fludarabine- and cyclophosphamide-based conditioning treatment varied according to the tumor burden in the bone marrow (BM) and peripheral blood (PB). CAR T cells were transfused to patients. Each day CAR T cells were transported to hospital, washed, counted, checked for viability and then prepared for administration to patients, who were then observed closely for at least 2 hours. CRS was graded according to a revised grading system (See Lee DW. et al, Blood 2014; 124:188-95). Other toxicities during and after therapy were assessed according to the National Institutes of Health Common Terminology Criteria for Adverse Events Version 4.0 (http://ctep.cancer.gov/). Therapy responses were assessed by flow cytometry and morphological analysis. When possible, patients were assessed by chimeric gene expression levels. The response type was defined as minimal residual disease (MRD) negative, complete response, complete response with incomplete count recovery, stable disease, and progressive disease.

Serial BM and PB samples after CAR T cell infusion were collected in K2EDTA BD vacutainer tubes (BD). The persistence of CAR19 T cells from fresh PB and BM in patients was determined by FACS. Circulating CAR T cell numbers per ul were calculated on the basis of measured absolute CD3+T lymphocyte counts. Simultaneously, CAR DNA copies were evaluated as another method of determining CAR T cell expansion and persistence. Genomic DNA was extracted using a QIAamp DNA Blood Mini Kit (Qiagen) from cryopreserved PB and BM. CAR DNA copies were assessed by quantitative real-time PCR as described in the supplementary materials. The levels of cytokines IFN-γ, TNF-α, IL-4, IL-6, IL-10, IL-17, etc. in serum and CSF were measured in a multiplex format according to the manufacturer's instructions.

Genomic DNA was extracted using a QIAamp DNA Blood Mini Kit (Qiagen) from cryopreserved peripheral blood and bone marrow. Quantitative PCR (qPCR) was performed in real-time in triplicates using the ABI 2× TaqMan Universal Master Mix with AmpErase UNG (Applied Biosystems) in a 7500 real-time PCR system (Applied Biosystems). Copy numbers per microgram of genomic DNA were calculated from a standard curve of 10-fold serial dilutions of purified CAR plasmid containing 102-108 copies/μL. Amplification of an internal control gene was used for normalization of DNA quantities. Primers/probes specific for the CAR19 transgene and an internal control gene were as previously described (see Gökbuget N. et al., Blood 2012; 120:2032-41 and O'Brien S. et al, J Clin Oncol 2013; 31:676-83).

Figure 40:
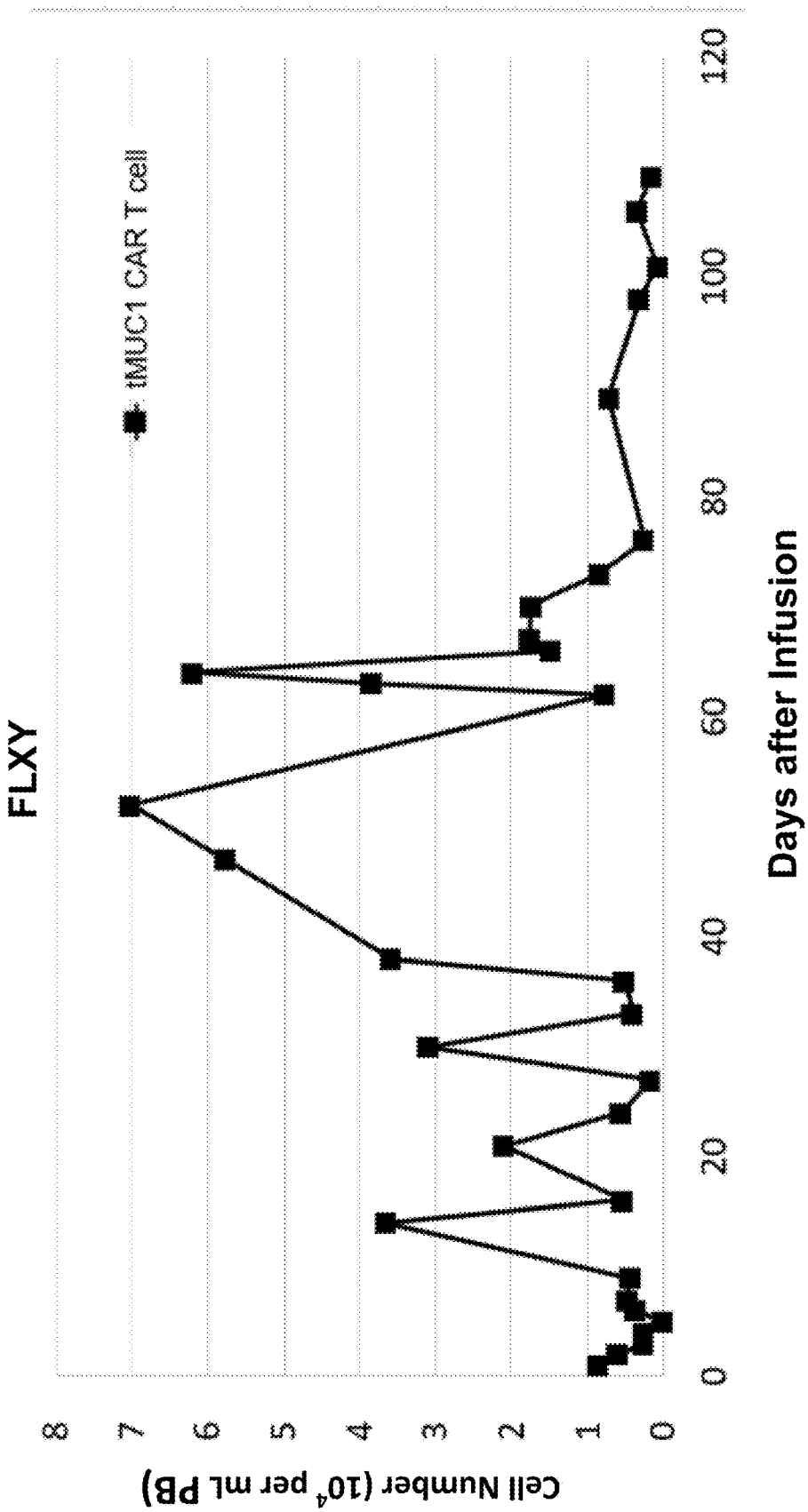
FIG. 40 shows CAR T cell number changes of a patient in response to infusion of T cells expressing tMUC1 CAR.
Figure 41:
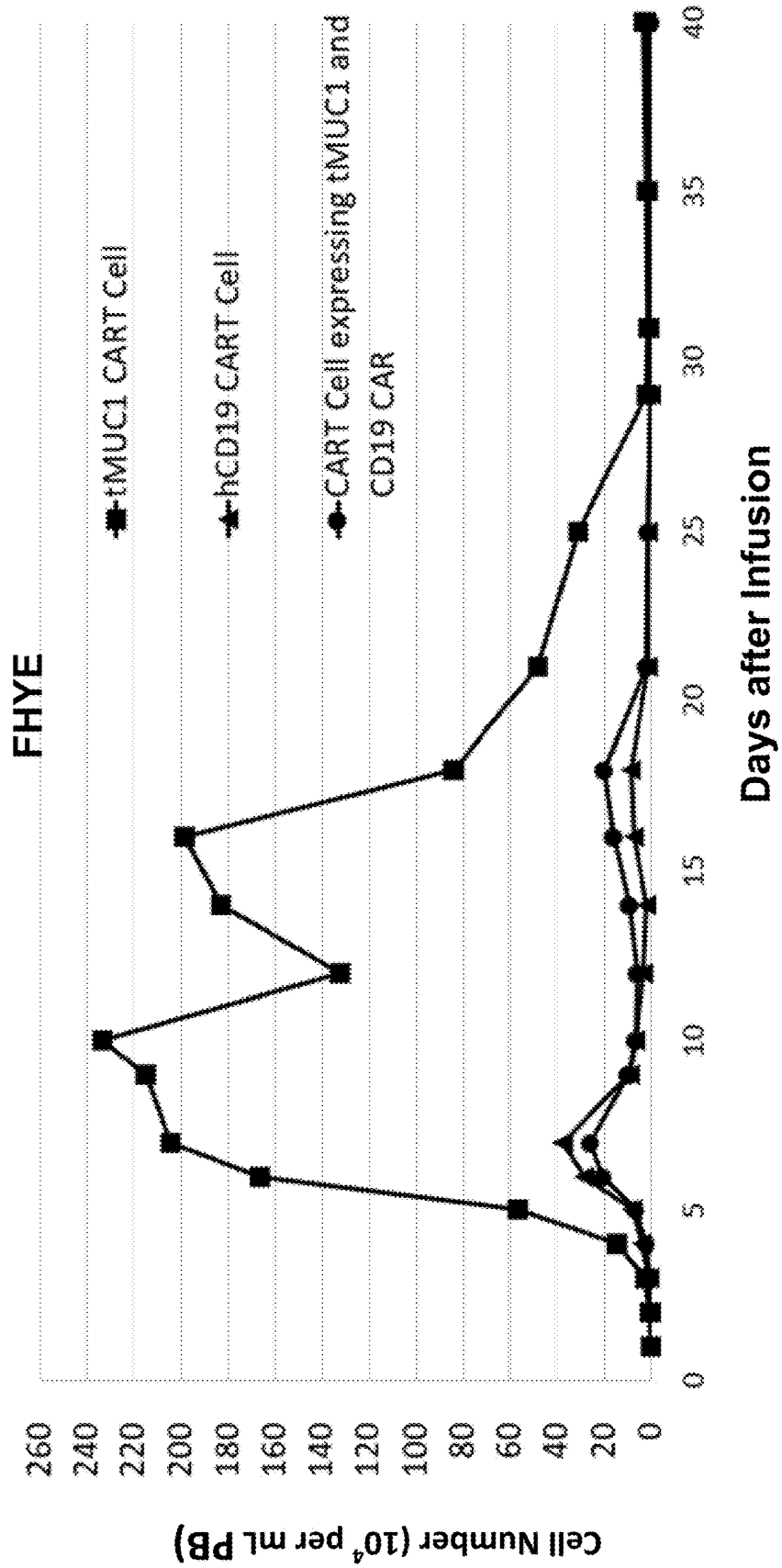
FIG. 41 shows CAR T cell number changes of a patient in response to infusion of T cells expressing tMUC1 CAR and CD19 CAR.

CAR T cell expansion were observed based on CAR copy numbers of individual CARs and shown in FIGS. 38A-38C and 39A-39B. As shown in these figures, CAR T cells expansion in FHYE and FSYM were significantly higher than those of MFPH, MBIXI, and FLXY, indicating that T cells expressing CD19 CAR and/or CD19 CAR and tMUC1 CAR enhance CRR T cell expansion (Also see Table 17). In FHYE and FLXY, T cells expressing CD19 CAR, tMUC1 CAR, and double CARs (CD19 CAR and tMUC1 CAR) were calculated using the following equations:

WBC X CD3% X (((MUC1CAR+CD19CAR−)/CD3),
WBC X CD3% X ((tMUC1CAR−CD19CAR+)/CD3), and
WBC X CD3% X ((tMUC1CAR+CD19CAR+)/CD3), wherein WBC is the number of WBC; CD3% is the percentage of CD3 positive cells in WBC; (tMUC1CAR+CD19CAR−)/CD3 is the percentage of T cells expressing tMUC1 CAR, with no CD19 CAR in CD3 positive cells; (tMUC1CAR−CD19CAR+)/CD3 is the percentage of T cells expressing CD19 CAR, with no tMUC1 CAR in CD3 positive cells; and (tMUC1CAR+CD19CAR+)/CD3 is the percentage of T cells expressing CD19 CAR and tMUC1 CAR in CD3 positive cells. Data is shown in FIGS. 40 and 41. As shown in these figures, CD19 CAR or double CAR T cells significantly increased expansion of tMUC1 CAR T cells, indicating that presence of CD19 CAR enhances increased expansion of tMUC1 CAR T cells.

Activation of Mixed CAR T Cell

CAR 1204 is a human-derived CAR, which can be labeled with human CAR antibody and CD137 antibody. CAR 2407 (tMuc1 CAR) is a murine CAR that can be labeled for activation with a murine CAR antibody and a CD137 antibody. Cells expressing CAR 1204 (CD19 CAR T cells) can be activated by K562 cells expressing CD19, resulting in up-regulated CD137 expression. CAR 1204 cells, CAR 2407 cells, and K562 cells expressing CD19 were co-cultured to induce CD19 CAR activation. The activation of 2407 CAR T cells was detected and measured based on the expression of CD137, which evidence activation of CD19 CAR indirectly.

Peripheral blood of healthy volunteers was collected on DAY 0. CD3+ T cells were sorted using Pan T kits, and CD3/CD28 Dynabeads were added at a 1:1 ratio. DAY 1, CD3+ T cells were transfected with lentivirus encoding. The binding domains of CD19 CAR and tMUC1 CAR include SEQ ID NOs: 5 and 70, respectively. On Day 2, the lentivirus and the Dynabeads were removed, and fresh media were added. On DAY 6, CAR ratios and cell phenotype were determined. Expression of CAR in these two group of cells was measured (CD19 CAR 61.86% and tMUC1 CAR 43.18%).

CD19 CAR T cells, tMuc1 CAR T cells, and target cells were selected and mixed for 24 hours according to Table 18 or 48 hours according to Table 19. Expression of various markers in corresponding cells was measured (see Table 18 (without PBMC) and Table 19 (with PBMC). $20 \times 10^4$ CAR T cells and $20 \times 10^4$ tumors were co-cultured for 24 hrs. The expression of hCAR/mCAR, CD25, and CD137 in T cells was measured by flow cytometry (hCAR+: CD19CAR and mCAR+: MUC1CAR; 1204: CD19CAR and 2407: tMUC1 CAR). CD25 and CD137 positive staining indicated that T cells were activated. Cytokines IL6 and IL15 were added to both the experimental group and the control group to verify that the cytokines had an effect on the experiment. Substrate cells were K19 (K562 cell expressing CD19). As shown in Table 18 and Table 19, activation levels of mCAR+ (MUC1 CAR) cells in the experimental group (1204+2407+K19 group) were significantly increased, as compared with the control group 2407+K19. It was proved that CD19+K19 substrate cells activated CD19 CAR T cells (1204 cells), and then indirectly cause the activation of tMUC1 CAR T cells (2407 cells). The presence of cytokines IL6 and IL15 showed no significant effect. The results of cells co-cultured for 48 hours showed similar results (See FIGS. 47 and 48).

Figure 47:
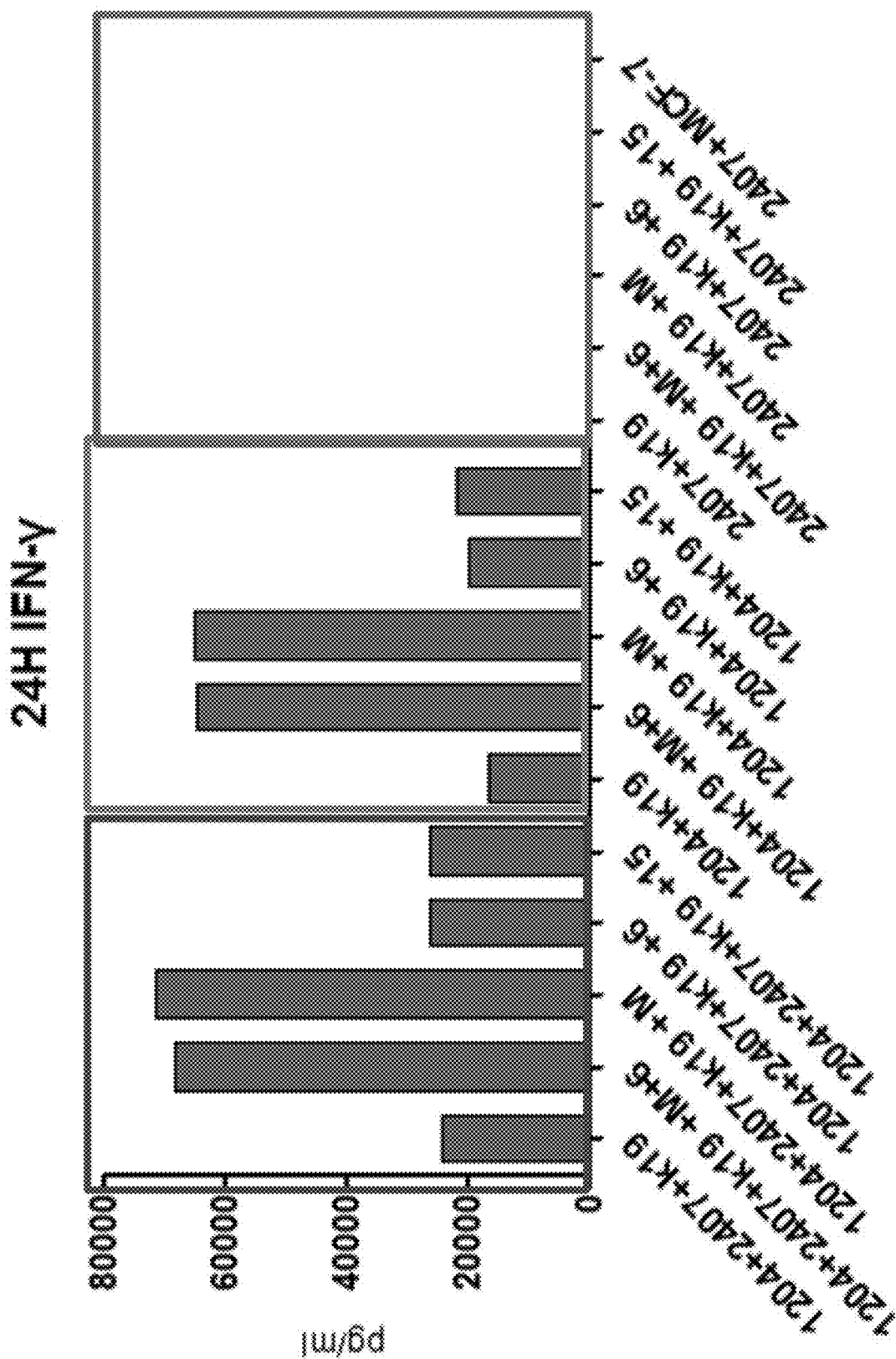
FIG. 47 shows cytokine release from various T cells in response to antigen activation.
Figure 48:
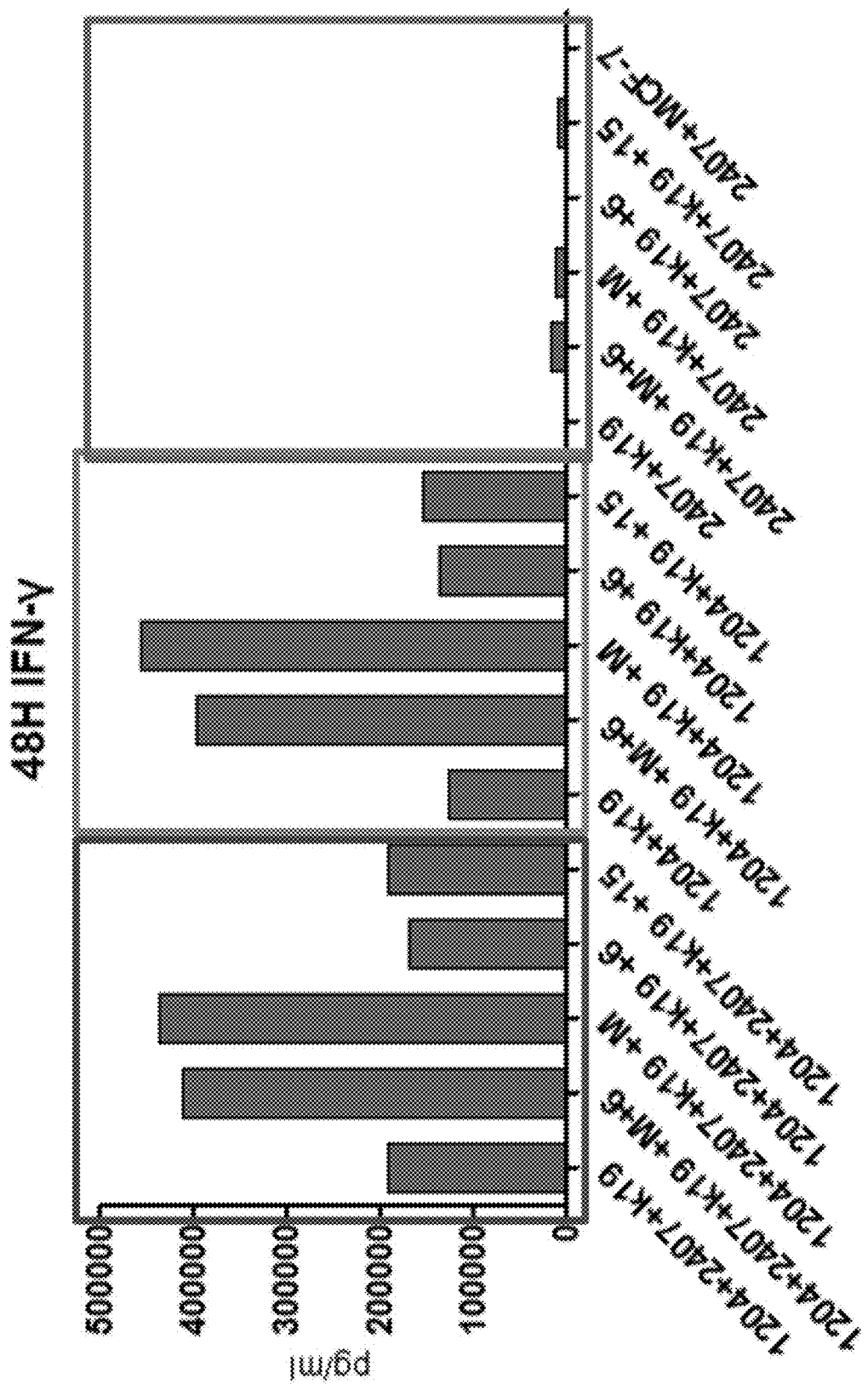
FIG. 48 shows other examples of cytokine release from various T cells in response to antigen activation.
Figure 49A:
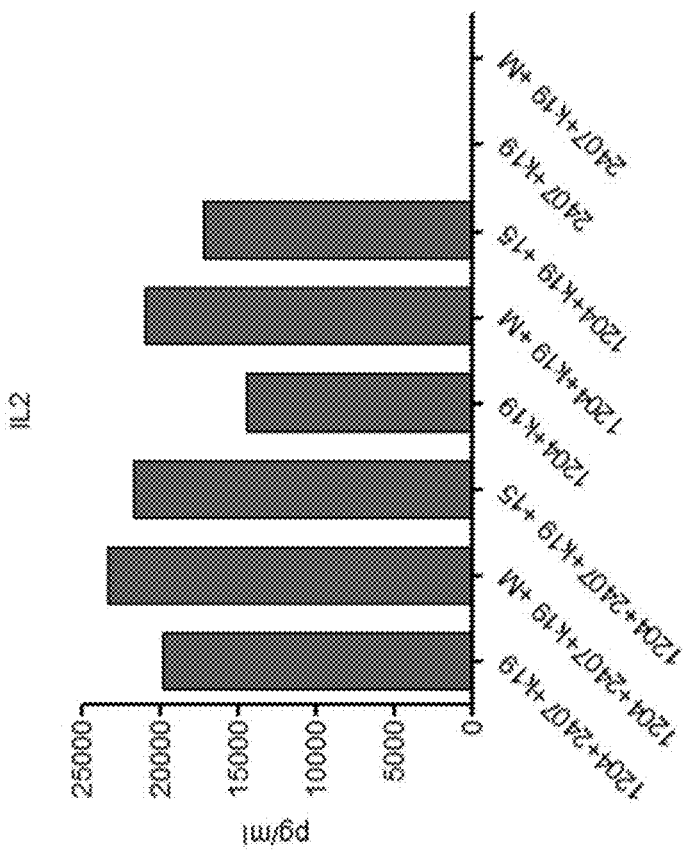
FIGS. 49A-49B show yet other examples of cytokine release from various T cells in response to antigen activation.
Figure 49B:
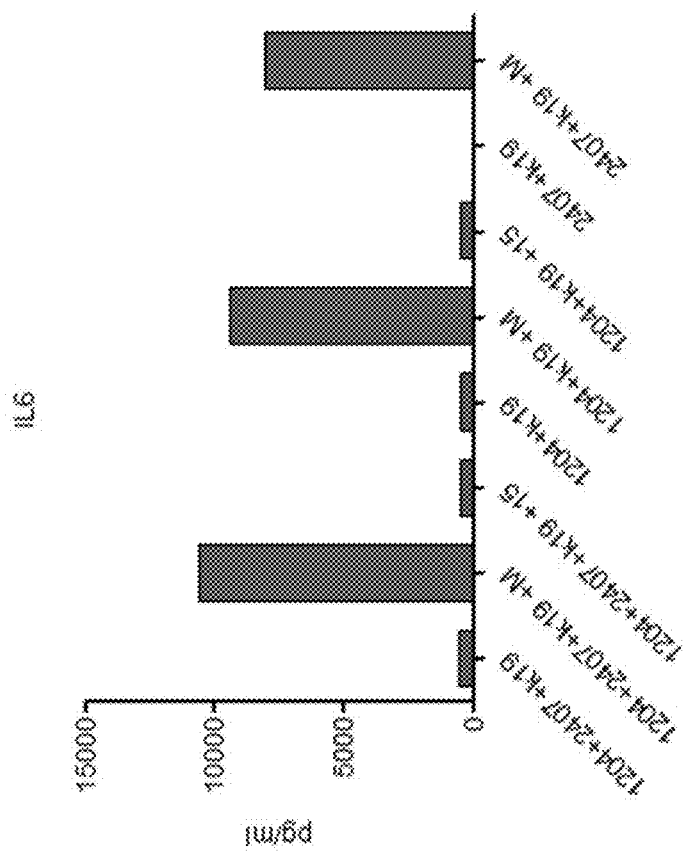
Figure 50B:
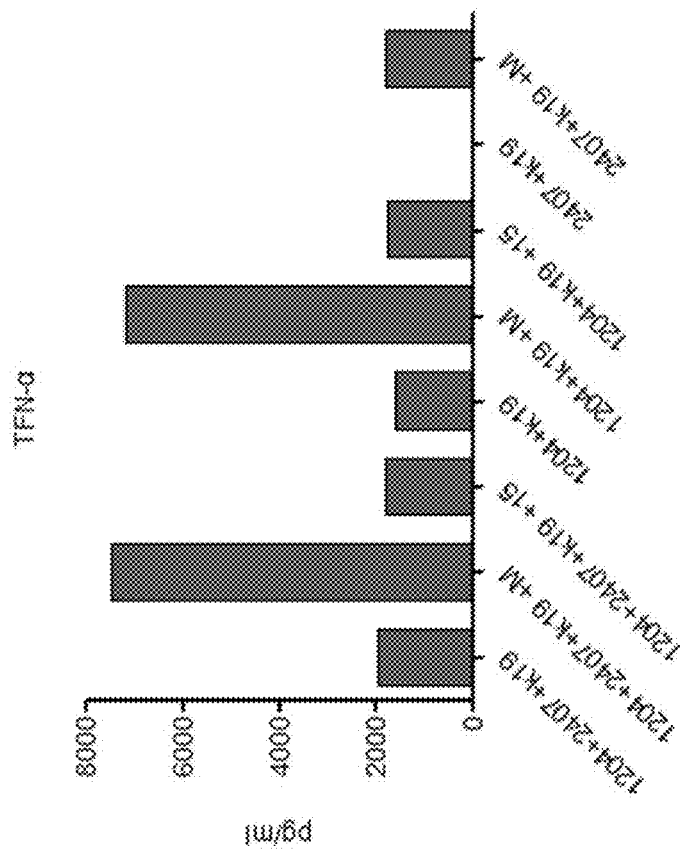
FIGS. 50A-50B show yet other examples of cytokine release from various T cells in response to antigen activation.
Figure 50A:
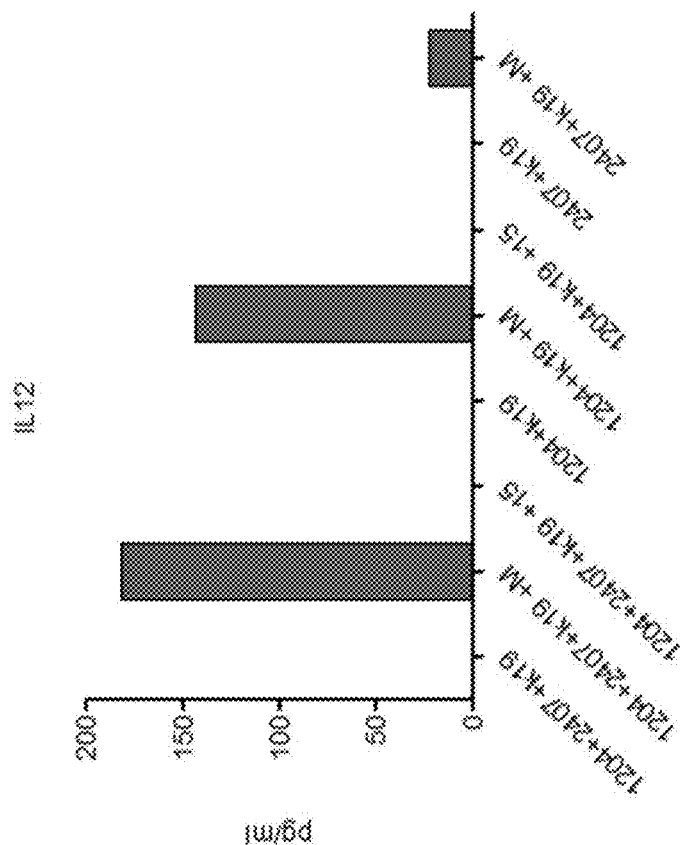
Figure 51:
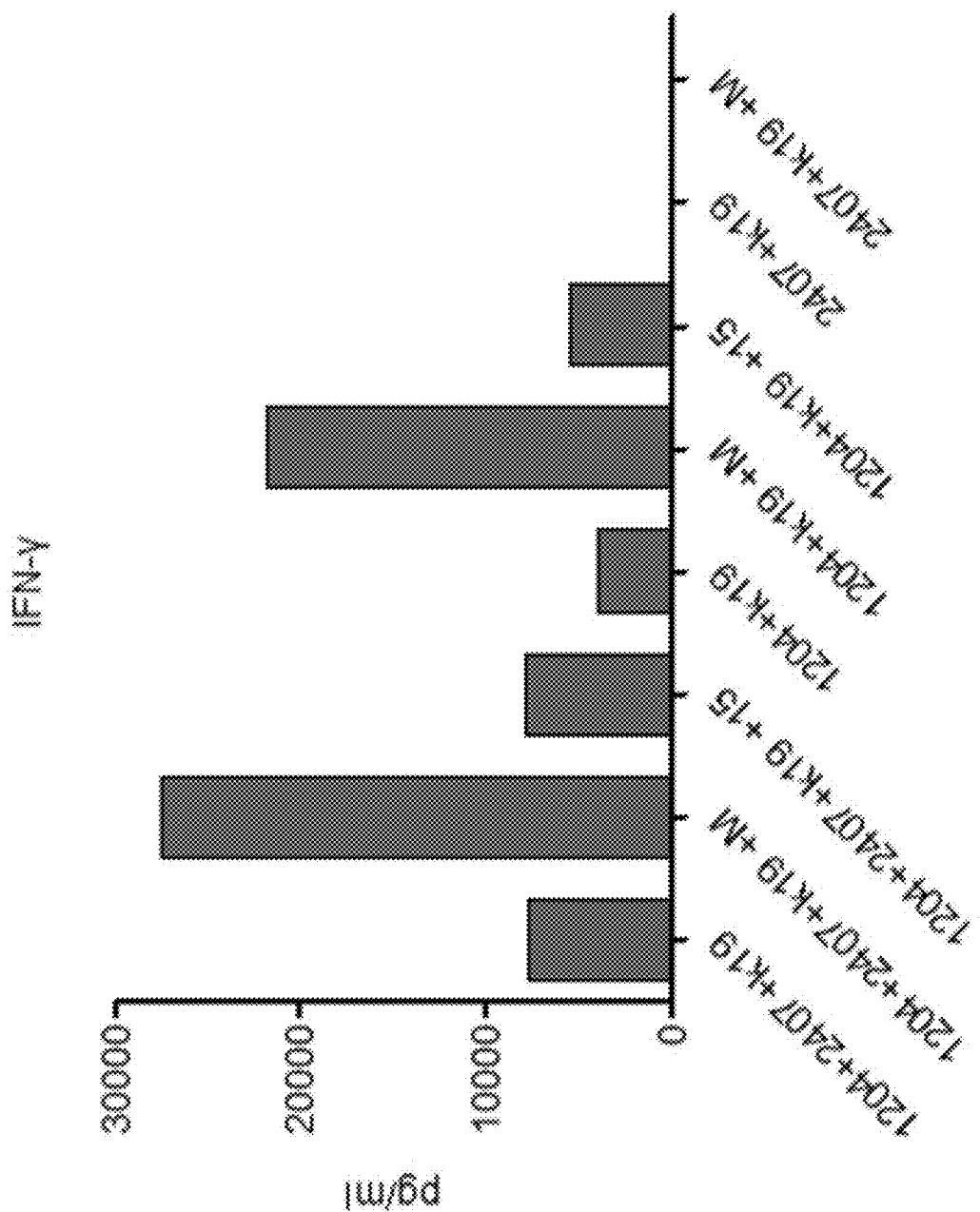
FIG. 51 shows yet another example of cytokine release from various T cells in response to antigen activation.

Amounts of IFN-γ released from various T cells were measured in response to the antigen activation as shown in Table 18 and Table 19, and background of the corresponding T cells was subtracted. The supernatant of the co-cultured cells was centrifuged at 24 h, and the release of IFN-γ was measured using an Elisa kit. The release of IFN-γ was used to indicate the degree of T cell activation. As shown in FIGS. 47 and 48, K562-CD19 cells activated CD19 CAR T cells (1204 cells) but failed to directly activate tMUC1 CAR T cells (2407 cells), and the presence of PBMC enhanced the IFN release, indicating that other cells in PBMC may play a positive role in the activation of T cells.

Further, monocytes were isolated by removing T cells using CD4/CD8 beads Kit from PBMC of healthy donors. The remaining PBMC mainly included monocytes and a little amount of other cells. The CD14 Kit was further used to sort out more pure monocytes (thus excluding other cells such as B cell interference) such as to verify whether the addition of monocyte has a positive effect on T cell activation. Protocols similar to those in Table 18 and Table 19 were used for the following examples except for using monocytes instead of PBMC. Flow cytometry was used to detect the five factors of IL2, IL6, IL12, TNF-α, and IFN-γ. The groups were co-cultured for 24 hours, and the experimental group with high dose of IL6 (1000 ng/ml) was removed. As shown in FIGS. 49A-49B, 50A-50B, and 51, there was no significant difference to IL2. When monocytes (M) were added to the media, the amount of other factors (IL6, IL12, TNF-α, IFN-γ) released increased significantly. As reported, IL6 and IL12 were secreted by monocytes, and monocytes may effectively stimulate T cell secretion of TNF-α and IFN-γ. These results demonstrate that activation of CD19 CAR T cells may activate monocytes to release cytokines such as TNF-α and IFN-γ, which then activate tMUC1 CAR T cells. Thus, these results also indicate that activation of CD19 CAR T cells by CD19 cause activation of tMUC1 CAR T cells, and monocytes enhance the activation.

TABLE 18

| activation cytokine | Grouping | | | | Target cell | CAR difference | Activate markers | | | | cytokine |
| --- | --- | --- | --- | --- | --- | --- | --- | --- | --- | --- | --- |
| | CARs | PBMC | IL6 | IL15 | K19 | staining | CD25 | MFI | CD137 | CD137MFI | IFN-γ |
| test group | 1204 + 2407 | − | − | − | − | hCAR+ | 5.35% | 3757.2 | 0.17% | 5839.1 | −552.44 |
| | | | | | | mCAR+ | 35.79% | 4228.4 | 1.20% | 7606 | |
| | 1204 + 2407 | + | + | − | − | hCAR+ | 10.90% | 4804.3 | 5.89% | 9653.3 | −223.4 |
| | | | | | | mCAR+ | 38.05% | 4722 | 3.02% | 9908.2 | |
| | 1204 + 2407 | + | − | − | − | hCAR+ | 9.10% | 3982.2 | 2.86% | 9084 | −241.68 |
| | | | | | | mCAR+ | 40.21% | 4903.7 | 3.00% | 6892.6 | |
| | 1204 + 2407 | − | + | − | − | hCAR+ | 2.97% | 3535.4 | 0.13% | 6849.4 | −333.08 |
| | | | | | | mCAR+ | 39.38% | 4328.8 | 1.00% | 9232.7 | |
| | 1204 + 2407 | − | − | + | − | hCAR+ | 15.70% | 3978.4 | 0.11% | 12450 | −479.32 |
| | | | | | | mCAR+ | 57.86% | 4965.4 | 1.19% | 4885.2 | |
| | 1204 + 2407 | − | − | − | + | hCAR+ | 50.65% | 6313.2 | 50.41% | 24099.4 | 23814.8 |
| | | | | | | mCAR+ | 48.50% | 6782.4 | 9.76% | 10348.1 | |
| | 1204 + 2407 | + | + | − | + | hCAR+ | 49.76% | 7384.5 | 25.13% | 17218.3 | 68235.2 |
| | | | | | | mCAR+ | 51.76% | 7212.8 | 5.92% | 12529.4 | |
| | 1204 + 2407 | + | − | − | + | hCAR+ | 47.48% | 6777.7 | 26.75% | 16989.3 | 71287.96 |
| | | | | | | mCAR+ | 49.64% | 6834.1 | 8.41% | 9075.6 | |

TABLE 18-continued

| activation cytokine | Grouping | | | | Target cell K19 | CAR difference staining | Activate markers | | | | cytokine IFN-y |
|---|---|---|---|---|---|---|---|---|---|---|---|
| | CARs | PBMC | IL6 | IL15 | | | CD25 | CD25 MFI | CD137 | CD137MFI | |
| | 1204 + 2407 | − | + | − | + | hCAR+ | 55.14% | 6972.4 | 43.79% | 23388.7 | 26026.68 |
| | | | | | | mCAR+ | 50.35% | 6665.9 | 12.24% | 15037.9 | |
| | 1204 + 2407 | − | − | + | + | hCAR+ | 57.78% | 7230.7 | 48.14% | 26729.8 | 25935.28 |
| | | | | | | mCAR+ | 54.04% | 6568.5 | 9.39% | 11900.5 | |
| control | 1204 | − | − | − | + | hCAR+ | 53.08% | 6202.5 | 57.41% | 26836.7 | 16027.52 |
| | 1204 | + | + | − | + | hCAR+ | 48.34% | 6738.5 | 35.63% | 18114.7 | 64286.72 |
| | 1204 | + | − | − | + | hCAR+ | 53.01% | 7078.2 | 39.85% | 19022.6 | 64780.28 |
| | 1204 | − | + | − | + | hCAR+ | 52.31% | 6476.1 | 55.80% | 23390.1 | 19226.52 |
| | 1204 | − | − | + | + | hCAR+ | 57.06% | 6055.4 | 62.09% | 25453.1 | 21328.72 |
| | 1204 | − | − | − | − | hCAR+ | 3.21% | 3839.8 | 0.25% | 7337.1 | −552.44 |
| | 1204 | + | + | − | − | hCAR+ | 6.39% | 4802.2 | 3.79% | 10004.1 | −186.84 |
| | 1204 | + | − | − | − | hCAR+ | 6.56% | 4731.4 | 4.98% | 11195.4 | −369.64 |
| | 1204 | − | + | − | − | hCAR+ | 3.42% | 3686.7 | 0.36% | 12472 | −515.88 |
| | 1204 | − | − | + | − | hCAR+ | 20.90% | 4051.8 | 0.22% | 21654.6 | −497.6 |
| | 2407 | − | − | − | + | mCAR+ | 26.27% | 4206.3 | 1.42% | 6336.6 | −534.16 |
| | 2407 | + | + | − | + | mCAR+ | 25.36% | 4234.7 | 2.57% | 6242.3 | −168.56 |
| | 2407 | + | − | − | + | mCAR+ | 23.23% | 4183.1 | 2.51% | 6305.5 | −259.96 |
| | 2407 | − | + | − | + | mCAR+ | 26.64% | 4138.1 | 1.03% | 6524.5 | −515.88 |
| | 2407 | − | − | + | + | mCAR+ | 48.22% | 5083.9 | 2.02% | 5906.4 | −113.72 |
| | 2407 | − | − | − | − | mCAR+ | 28.87% | 4366.4 | 0.54% | 5428.1 | −534.16 |
| | 2407 | + | + | − | − | mCAR+ | 26.93% | 4451.5 | 1.09% | 4772.9 | −534.16 |
| | 2407 | + | − | − | − | mCAR+ | 41.79% | 4499.1 | 0.75% | 7200 | −497.6 |
| | 2407 | − | + | − | − | mCAR+ | 29.87% | 4339.1 | 0.92% | 7197.7 | −570.72 |
| | 2407 | − | − | + | − | mCAR+ | 31.10% | 4591.2 | 0.62% | 6639.6 | −534.16 |
| | 2407 | − | − | − | +MCF- | mCAR+ | 14.64% | 5732.4 | 11.03% | 12442.8 | −296.52 |

TABLE 19

| activation cytokine | Grouping | | | | Target cell K19 | CAR staining difference | Activate markers | | | | cytokine IFN-y |
|---|---|---|---|---|---|---|---|---|---|---|---|
| | CARs | PBMC | IL6 | IL15 | | | CD25 | CD25 MFI | CD137 | CD137MFI | |
| test group | 1204 + 2407 | − | − | − | − | hCAR+ | 0.59% | 7201 | 0.30% | 6490.3 | −995.2 |
| | | | | | | mCAR+ | 7.72% | 7271 | 0.34% | 5519.4 | |
| | 1204 + 2407 | + | + | − | − | hCAR+ | 6.09% | 11900.5 | 4.63% | 11684.9 | 211.28 |
| | | | | | | mCAR+ | 15.03% | 8705.3 | 2.07% | 13086 | |
| | 1204+ 2407 | + | − | − | − | hCAR+ | 4.70% | 9593.5 | 3.52% | 11349.9 | −519.92 |
| | | | | | | mCAR+ | 14.97% | 7864.3 | 1.35% | 37280.8 | |
| | 1204 + 2407 | − | + | − | − | hCAR+ | 0.88% | 7177 | 0.59% | 7144.6 | −885.52 |
| | | | | | | mCAR+ | 9.01% | 7017.3 | 0.42% | 27054.7 | |
| | 1204 + 2407 | − | − | + | − | hCAR+ | 9.01% | 7079.3 | 0.21% | 9538.1 | −848.96 |
| | | | | | | mCAR+ | 39.95% | 8478.6 | 0.31% | 5296.2 | |
| | 1204+2407 | − | − | − | + | hCAR+ | 41.85% | 11764.6 | 40.28% | 50600.5 | 141990.96 |
| | | | | | | mCAR+ | 37.51% | 12667.1 | 5.27% | 7891.7 | |
| | 1204 + 2407 | + | + | − | + | hCAR+ | 40.77% | 11240.4 | 18.81% | 38202.8 | 155627.84 |
| | | | | | | mCAR+ | 39.86% | 12645.4 | 3.13% | 6836 | |
| | 1204 + 2407 | + | − | − | + | hCAR+ | 44.54% | 11374.1 | 19.18% | 37645.9 | 147072.8 |
| | | | | | | mCAR+ | 43.02% | 12775.1 | 3.84% | 7086 | |
| | 1204 + 2407 | − | + | − | + | hCAR+ | 45.62% | 12786.8 | 41.43% | 52523.2 | 139358.64 |
| | | | | | | mCAR+ | 52.54% | 15024.8 | 5.90% | 7943.2 | |
| | 1204 + 2407 | − | − | + | + | hCAR+ | 48.73% | 12211.3 | 45.65% | 53723.8 | 142722.16 |
| | | | | | | mCAR+ | 55.60% | 15113.3 | 6.75% | 7503.3 | |
| control | 1204 | − | − | − | + | hCAR+ | 41.46% | 11072.4 | 57.34% | 52646.2 | 114315.04 |
| | 1204 | + | + | − | + | hCAR+ | 34.23% | 11200.3 | 27.97% | 42956.6 | 152154.64 |
| | 1204 | + | − | − | + | hCAR+ | 35.80% | 11839.8 | 47.06% | 24782.7 | 160234.4 |
| | 1204 | − | + | − | + | hCAR+ | 39.11% | 12286.8 | 57.59% | 51509.1 | 120237.76 |
| | 1204 | − | − | + | + | hCAR+ | 43.36% | 11446.8 | 58.65% | 51851.5 | 133728.4 |
| | 1204 | − | − | − | − | hCAR+ | 0.61% | 7182.4 | 0.43% | 8983.2 | −958.64 |
| | 1204 | + | + | − | − | hCAR+ | 5.96% | 12959 | 5.70% | 12726.4 | 905.92 |
| | 1204 | + | − | − | − | hCAR+ | 5.57% | 13200.9 | 5.34% | 13486.8 | 101.6 |
| | 1204 | − | + | − | − | hCAR+ | 0.67% | 6370.3 | 0.19% | 11692.5 | −1178 |
| | 1204 | − | − | + | − | hCAR+ | 9.09% | 7187.6 | 0.27% | 9374.5 | −1031.76 |
| | 2407 | − | − | − | + | mCAR+ | 10.40% | 9467.1 | 1.79% | 10939.4 | −848.96 |
| | 2407 | + | + | − | + | mCAR+ | 23.82% | 10940.8 | 3.50% | 8288.2 | 18271.92 |
| | 2407 | + | − | − | + | mCAR+ | 22.50% | 11210.2 | 3.12% | 10296 | 13738.48 |
| | 2407 | − | + | − | + | mCAR+ | 10.55% | 8999 | 1.77% | 9501.6 | −190.88 |
| | 2407 | − | − | + | + | mCAR+ | 40.17% | 11957.6 | 3.90% | 7972.6 | 8876 |
| | 2407 | − | − | − | − | mCAR+ | 6.35% | 6917.3 | 0.16% | 6821.2 | −1324.24 |

TABLE 19-continued

| activation cytokine | CARs | Grouping | | | Target cell | CAR staining | Activate markers | | | | cytokine |
|---|---|---|---|---|---|---|---|---|---|---|---|
| | | PBMC | IL6 | IL15 | K19 | difference | CD25 | CD25 MFI | CD137 | CD137MFI | IFN-y |
| | 2407 | + | + | − | − | mCAR+ | 5.28% | 6973.9 | 0.11% | 14984.3 | −1251.12 |
| | 2407 | + | − | − | − | mCAR+ | 7.05% | 7251.9 | 0.25% | 7808.9 | −1251.12 |
| | 2407 | − | + | − | − | mCAR+ | 6.85% | 7342.9 | 0.02% | 12941.3 | −1287.68 |
| | 2407 | − | − | + | − | mCAR+ | 29.56% | 8256.9 | 0.13% | 8006.5 | −1031.76 |
| | 2407 | − | − | − | +MCF-7 | mCAR+ | 11.17% | 9191.1 | 4.88% | 18459.5 | −44.64 |

All publications, patents and patent applications cited in this specification are incorporated herein by reference in their entireties as if each individual publication, patent or patent application were specifically and individually indicated to be incorporated by reference. While the foregoing has been described in terms of various embodiments, the skilled artisan will appreciate that various modifications, substitutions, omissions, and changes may be made without departing from the spirit thereof.

SEQUENCE LISTING (439 sequences)

SEQ ID NO: 1 - protein, 21 aa, Artificial Sequence
  Synthesized
MALPVTALLLPLALLLHAARP

SEQ ID NO: 2 - protein, 69 aa, Artificial Sequence
  Synthesized
AKPTTTPAPRPPTPAPTIASQPLSLRPEACRPAAGGAVHTRGLDFACDIYIWAPLAGTCGVLLLSLVIT

SEQ ID NO: 3 - protein, 42 aa, Artificial Sequence
  Synthesized
KRGRKKLLYIFKQPFMRPVQTTQEEDGCSCRFPEEEEGGCEL

SEQ ID NO: 4 - protein, 112 aa, Artificial Sequence
  Synthesized
RVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 5 - protein, 242 aa, Artificial Sequence
  Synthesized
DIQMTQSPSSLSASVGDRVTITCRASQDISKYLNWYQQKPGKAPKLLIYHTSRLHSGVPSRFSGSGSGTDFTLTISSLQPEDFATYYCQQGNTLPYTFGQGTKVEIKGGGGSGGGGSGGGGSEVQLVESGGGLVQPGGSLRLSCAASGVSLPDYGVSWVRQAPGKGLEWVSVIWGSETTYYNSALKSRFTISRDNAKNSLYLQMNSLRAEDTAVYYCAKHYYYGGSYAMDYWGQGTLVTVSS

SEQ ID NO: 6 - protein, 242 aa, Artificial Sequence
  Synthesized
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSS

SEQ ID NO: 7 - protein, 237 aa, Artificial Sequence
  Synthesized
DIQMTQSPASLSVSVGETVTITCRASENIYSNLAWYQQKQGKSPQLLVYVATNLADGVPSRFSGSGSGTQYSLKINSLQSEDFGSYYCQHFWGTPYTFGGGTKLGGGGSGGGGSGGGGSEVQLQQSGAELVKPGASVKLSCTASGFNINDTYMHWVKQRPEQGLEWIGRIDPANGNTKYDPKFQGKATITADTSSNTAYLQLSSLTSEDTAVYYCARGARGSRFAYWGQGTLVTVSA

SEQ ID NO: 8 - protein, 244 aa, Artificial Sequence
  Synthesized
QSVLTQPPSVSAAPGQKVTISCSGSSSDIGSNYVSWYQQFPGTAPKLLIYDNNKRPSAIPDRFSGSKSGTSATLGITGLQTGDEADYYCGTWDSRLGIAVFGGGTQLTVLGGGGSGGGGSGGGGSEVQLVQSGAEVKKPGQSLKISCKASGYSLTDNWIGWVRQKPGKGLEWMGIIYPGDSDTRYSPSFQGQVTISADKSINTAYLQWSSLKASDTAIYYCVGLDWNYNPLRYWGPGTLVTVSS

SEQ ID NO: 9 - protein, 252 aa, Artificial Sequence
  Synthesized
DIVLTQSPASLAVSLGQGATISCRASKSVSTSGYTYMHWYQQKPGQPPKLLIYLASNLESGVPARFSGSGSGTDFTLNIHPVEEEDAATYYCQHSGELPPSFGGGTKLEIKRAGGGGSGGGGSGGGGSEVQLVESGGDLVKPGGSLKLSCAVSGFTFSSYGMSWVRQTPDKRLEWVATVSSGGTYTYYPDSVKGRFTISRDNAKNTLYLQMSSLKSEDSAMYYCARHRGNYYATYYYAMDYWGQGTSVTVSS

SEQ ID NO: 10 - protein, 243 aa, Artificial Sequence
  Synthesized
DVQITQSPSYLAASPGETITINCRASKSISKYLAWYQEKPGKTNKLLIYSGSTLQSGIPSRFSGSGSGTDFTLTISSLEPEDFAMYYCQQHHEYPYTFGGGTKLEIKGGGGSGGGGSGGGGSQVQLQQPGAELVRPGASVKLSCKASGYTFTTYWMNWVKQRPEQGLEWIGRIDPYDSETHYNQKFKDKAILTVDKSSSTAYMQLSSLTSEDSAVYYCARGPYYGTNPWFPYWGQGTLVTVSS

SEQ ID NO: 11 - protein, 241 aa, Artificial Sequence
  Synthesized
EIVMTQSPATLSVSPGERATLSCRASQSVSRNLAWYQQKPGQAPRLLIYGASTRATGIPARFSGSGSGTEFTLTIGSLQSEDFAVYYCQQYKTWPRTFGQGTNVEIKGGGGSGGGGSGGGGSQVQLQQWGAGLLKPSETLSLTCAVFGGSFSGYYWSWIRQPPGKGLEWIGEINHRGNTNDNPSLKSRVTISVDTSKNQFALKLSSVTAADTAVYYCARERGYTYGNFDHWGQGTLVTVSS

SEQ ID NO: 12 - protein, 246 aa, Artificial Sequence
  Synthesized
DVVMTQTPLSLPVRLGDQASISCRSSQSLVHSNGNTYLHWYLQKPGQSPKLLIYKVSNRFSGVPDRFSGSGSGTNFTLKISRVEAEDLGLYFCSQSTHVPYTFGGGTKLEIKRAGGGGSGGGGSGGGGSQVQLRQSGPELVKPGASVKMSCKASGYTFTDYVISWVKQRTGQGLEWIGDIYPGSGYSFYNENFKGKATLTADKSSTTAYMQLSSLTSEDSAVYFCATYYNYPFAYWGQGTLVTVSA

SEQ ID NO: 13 - protein, 199 aa, Artificial Sequence
  Synthesized
LPICPGGAARCQVTLRDLFDRAVVLSHYIHNLSSEMFSEFDKRYTHGRGFITKAINSCHTSSLATPEDKEQAQQMNQKDFLSLIVSILRSWNEPLYHLVTEVRGMQEAPEAILSKAVEIEEQTKRLLEGMELIVSQVHPETKENEIYPVWSGLPSLQMADEESRLSAYYNLLHCLRRDSHKIDNYLKLLKCRIIHNNNC

SEQ ID NO: 14 - protein, 240 aa, Artificial Sequence
  Synthesized
DIVMTQSPDSLAVSLGERATINCKSSQSLLNSRTRKNYLAWYQQKPGQPPKLLIYWASTRESGVPDRFSGSGSGTDFTLTISSLQAEDVAVYYCTQSFILRTFGQGTKVEIKGGGGGSGGGGSGGGGSDIVMTQSPDSLAVSLGERATINCKSSQSLLNSRTRKNYLAWYQQKPGQPPKLLIYWASTRESGVPDRFSGSGSGTDFTLTISSLQAEDVAVYYCTQSFILRTFGQGTKVEIK

SEQ ID NO: 15 - protein, 281 aa, Artificial Sequence
  Synthesized
MNVPTQLLGLLLLWLTGGKCDIQMTQSPASLSASLEEIVTITCKASQAIDAYLSWYQQKPGKSPQLLIYDATSLADGVPSRFSGSRSGTQYSLKISRPQVDDSGIYYCLQSYSTPFTFGSGTKLEIKGGGGGSGGGGSGGGGSMAVLVLLLCLLIFPSCVLSQVQLKESGPGLVQPSQTLSLTCTVSGSSLTSNSVSWIRQPPGKGLEWMGVIWSNGDADYNSAIKSRLSISRDTSKSQVFLKMNSLQTEDTAMYFCASPYYGYYFPFDYWGQGVMVTVSS

SEQ ID NO: 16 - protein, 285 aa, Artificial Sequence
  Synthesized
METDTLLLWVLLLWVPGSTGDIVLTQSPALAVSLGQRATISCRASQSVSISSHDLMQWYQQKPGQQPKLLIYDAFNLASGIPVRFSGSGSGTDFTLTIDPVQADDIATYYCQQSKDDPYTFGAGTKLELKGGGGGSGGGGSGGGGSMDIRLSLAFLVLFIKGVQCEVQLVESGGGLVQPGRSMKLSCAASGFTFSNYGMAWVRQAPTKGLEWVATISYDGSITYYRDSVKGRFTISRDHAKSTLYLQMNSLRSEDTATYYCTREEQYSSWYFDFWGPGIMVTVSS

SEQ ID NO: 17 - protein, 242 aa, Artificial Sequence
  Synthesized
NIVMTQSPSSLSASVGDRVTITCQASQDVGTAVAWYQQKPDQSPKLLIYWTSTRHTGVPDRFTGSGSGTDFTLTISSLQPEDIATYFCHQYNSYNTFGSGTKLEIKGGGGGSGGGGSGGGGSQVTLKESGPVLVKPTETLTLTCTFSGFSLSTSGMGVGWIRQAPGKGLEWVAHIWWDDDVYYNPSLKSRLTITKDASKDQVSLKLSSVTAADTAVYYCVRRRATGTGFDYWGQGTLVTVSS

SEQ ID NO: 18 - protein, 272 aa, Homo sapiens
PEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGELFRWNVSDLGGLGCGLKNRSSEGPSSPSGKLMSPKLYVWAKDRPEIWEGEPPCLPPRDSLNQSLSQDLTMAPGSTLWLSCGVPPDSVSRGPLSWTHVHPKGPKSLLSLELKDDRPARDMWVMETGLLLPRATAQDAGKYYCHRGNLTMSFHLEITARPVLWHWLLRTGGWK

SEQ ID NO: 19 - protein, 205 aa, Homo sapiens
ISSMDMERPGDGKCQPIEIPMCKDIGYNMTRMPNLMGHENQREAAIQLHEFAPLVEYGCHGHLRFFLCSLYAPMCTEQVSTPIPACRVMCEQARLKCSPIMEQFNFKWPDSLDCRKLPNKNDPNYLCMEAPNNGSDEPTRGSGLFPPLFRPQRPHSAQEHPLKDGGPGRGGCDNPGKFHHVEKSASCAPLCTPGVDVYWSREDKR

SEQ ID NO: 20 - protein, 393 aa, Homo sapiens
GMGCSSPPCECHQEEDFRVTCKDIQRIPSLPPSTQTLKLIETHLRTIPSHAFSNLPNISRIYVSIDVTLQQLESHSFYNLSKVTHIEIRNTRNLTYIDPDALKELPLLKFLGIFNTGLKMFPDLTKVYSTDIFFILEITDNPYMTSIPVNAFQGLCNETLTLKLYNNGFTSVQGYAFNGTKLDAVYLNKNKYLTVIDKDAFGGVYSGPSLLDVSQTSVTALPSKGLEHLKELIARNTWTLKKLPLSLSFLHLTRADLSYPSHCCAFKNQKKIRGILESLMCNESSMQSLRQRKSVNALNSPLHQEYEENLGDSIVGYKEKSKFQDTHNNAHYYVFFEEQEDEIIGFGQELKNPQEETLQAFDSHYDYTICGDSEDMVCTPKSDEFNPCEDIMG

SEQ ID NO: 21 - protein, 210 aa, Homo sapiens
QLPPGKPEIFKCRSPNKETFTCWWRPGTDGGLPTNYSLTYHREGETLMHECPDYITGGPNSCHFGKQYTSMWRTYIMMVNATNQMGSSFSDELYVDVTYIVQPDPPLELAVEVKQPEDRKPYLWIKWSPPTLIDLKTGWFTLLYEIRLKPEKAAEWEIHFAGQQTEFKILSLHPGQKYLVQVRCKPDHGYWSAWSPATFIQIPSDFTMND

SEQ ID NO: 22 - protein, 4368 aa, Homo sapiens
EQDLSVNRAVWDGGGCISQGDVLNRQCQQLSQHVRTGSAANTATGTTSTNVVEPRMYLSCSTNPEMTSIESSVTSDTPGVSSTRMTPTESRTTSESTSDSTTLFPSSTEDTSSPTTPEGTDVPMSTPSEESISSTMAFVSTAPLPSFEAYTSLTYKVDMSTPLTTSTQASSSPTTPESTTIPKSTNSEGSTPLTSMPASTMKVASSEAITLLTTPVEISTPVTISAQASSSPTTAEGPSLSNSAPSGGSTPLTRMPLSVMLVVSSEASTLSTTPAATNIPVITSTEASSSPTTAEGTSIPTSTYTEGSTPLTSTPASTMPVATSEMSTLSITPVDTSTLVTTSTEPSSLPTTAEATSMLTSTLSEGSTPLTNMPVSTILVASSEASTTSTIPVDSKTFVTTASEASSSPTTAEDTSIATSTPSEGSTPLTSMPVSTTPVASSEASNLSTTPVDSKTQVTTSTEASSSPPTAEVNSMPTSTPSEGSTPLTSMSVSTMPVASSEASTLSTTPVDTSTPVTTSSEASSSSTTPEGTSIPTSTPSEGSTPLTNMPVSTRLVVSSEASTTSTTPADSNTFVTTSSEASSSSTTAEGTSMPTSTYSERGTTITSMSVSTTLVASSEASTLSTTPVDSNTPVTTSTEATSSSTTAEGTSMPTSTYTEGSTPLTSMPVNTTLVASSEASTLSTTPVDTSTPVTTSTEASSSPTTADGASMPTSTPSEGSTPLTSMPVSKTLLTSSEASTLSTTPLDTSTHITTSTEASCSPTTTEGTSMPISTPSEGSPLLTSIPVSITPVTSPEASTLSTTPVDSNSPVTTSTEVSSSPTPAEGTSMPTSTYSEGRTPLTSMPVSTTLVATSAISTLSTTPVDTSTPVTNSTEARSSPTTSEGTSMPTSTPGEGSTPLTSMPDSTTPVVSSEARTLSATPVDTSTPVTTSTEATSSPTTAEGTSIPTSTPSEGTTPLTSTPVSHTLVANSEASTLSTTPVDSNTPLTTSTEASSPPPTAEGTSMPTSTPSEGSTPLTRMPVSTTMVASSETSTLSTTPADTSTPVTTYSQASSSSTTADGTSMPTSTYSEGSTPLTSVPVSTRLVVSSEASTLSTTPVDTSIPVTTSTEASSSPTTAEGTSIPTSPPSEGTTPLASMPVSTTLVVSSEANTLSTTPVDSKTQVATSTEASSPPPTAEVTSMPTSTPGERSTPLTSMPVRHTPVASSEASTLSTSPVDTSTPVTTSAETSSSPTTAEGTSLPTSTTSEGSTLLTSIPVSTTLVTSPEASTLLTTPVDTKGPVVTSNEVSSSPTPAEGTSMPTSTYSEGRTPLTSIPVNTTLVASSAISILSTTPVDNSTPVTTSTEACSSPTTSEGTSMPNSNPSEGTTPLTSIPVSTTPVVSSEASTLSATPVDTSTPGTTSAEATSSPTTAEGISIPTSTPSEGKTPLKSIPVSNTPVANSEASTLSTTPVDSNSPVVTSTAVSSSPTPAEGTSIAISTPSEGSTALTSIPVSTTTVASSEINSLSTTPAVTSTPVTTYSQASSSPTTADGTSMQTSTYSEGSTPLTSLPVSTMLVVSSEANTLSTTPIDSKTQVTASTEASSSTTAEGSSMTISTPSEGSPLLTSIPVSTTPVASPEASTLSTTPVDSNSPVITSTEVSSSPTPAEGTSMPTSTYTEGRTPLTSITVRTTPVASSAISTLSTTPVDNSTPVTTSTEARSSPTTSEGTSMPNSTPSEGTTPLTSIPVSTTPVLSSEASTLSATPIDTSTPVTTSTEATSSPTTAEGTSIPTSTLSEGMTPLTSTPVSHTLVANSEASTLSTTPVDSNSPVVTSTAVSSSPTPAEGTSIATSTPSEGSTALTSIPVSTTTVASSETNTLSTTPAVTSTPVTTYAQVSSSPTTADGSSMPTSTPREGRPPLTSIPVSTTTVASSEINTLSTTLADTRTPVTTYSQASSSPTTADGTSMPTPAYSEGSTPLTSMPLSTTLVVSSEASTLSTTPVDTSTPATTSTEGSSSPTTAGGTSIQTSTPSERTTPLAGMPVSTTLVVSSEGNTLSTTPVDSKTQVTNSTEASSSATAEGSSMTISAPSEGSPLLTSIPLSTTPVASPEASTLSTTPVDSNSPVITSTEVSSSPIPTEGTSMQTSTYSDRRTPLTSMPVSTTVVASSAISTLSTTPVDTSTPVTNSTEARSSPTTSEGTSMPTSTPSEGSTPFTSMPVSTMPVVTSEASTLSATPVDTSTPVTTSTEATSSPTTAEGTSIPTSTLSEGTTPLTSIPVSHTLVANSEVSTLSTTPVDSNTPFTTSTEASSPPPTAEGTSMPTSTSSEGNTPLTRMPVSTTMVASFETSTLSTTPADTSTPVTTYSQAGSSPTTADDTSMPTSTYSEGSTPLTSVPVSTMPVVSSEASTHSTTPVDTSTPVTTSTEASSSPTTAEGTSIPTSPPSEGTTPLASMPVSTTPVVSSEAGTLSTTPVDTSTPMTTSTEASSSPTTAEDIVVPISTASEGSTLLTSIPVSTTPVASPEASTLSTTPVDSNSPVVTSTEISSSATSAEGTSMPTSTYSEGSTPLRSMPVSTKPLASSEASTLSTTPVDTSIPVTTSTETSSSPTTAKDTSMPISTPSEVSTSLTSILVSTMPVASSEASTLSTTPVDTRTLVTTSTGTSSSPTTAEGSSMPTSTPGERSTPLTNILVSTTLLANSEASTLSTTPVDTSTPVTTSAEASSSPTTAEGTSMRISTPSDGSTPLTSILVSTLPVASSEASTVSTTAVDTSIPVTTSTEASSSPTTAEVTSMPTSTPSETSTPLTSMPVNHTPVASSEAGTLSTTPVDTSTPVTTSTKASSSPTTAEGIVVPISTASEGSTLLTSIPVSTTPVASSEASTLSTTPVDTSIPVTTSTEGSSSPTTAEGTSMPISTPSEVSTPLTSILVSTVPVAGSEASTLSTTPVDTRTPVTTSAEASSSPTTAEGTSMPISTPGERRTPLTSMSVSTMPVASSEASTLSRTPADTSTPVTTSTEASSSPTTAEGTGIPISTPSEGSTPLTSIPVSTTPVAIPEASTLSTTPVDSNSPVVTSTEVSSSPTPAEGTSMPISTYSEGSTPLTGVPVSTTPVTSSAISTLSTTPVDTSTPVTTSTEAHSSPTTSEGTSMPTSTPSEGSTPLTYMPVSTMLVVSSEDSTLSATPVDTSTPVTTSTEATSSTTAEGTSIPTSTPSEGMTPLTSVPVSNTPVASSEASILSTTPVDSNTPLTTSTEASSSPPTAEGTSMPTSTPSEGSTPLTSMPVSTTTVASSETSTLSTTPADTSTPVTTYSQASSSPPIADGTSMPTSTYSEGSTPLTNMSFSTTPVVSSEASTLSTTPVDTSTPVTTSTEASLSPTTAEGTSIPTSSPSEGTTPLASMPVSTTPVVSSEVNTLSTTPVDSNTLVTTSTEASSSPTIAEGTSLPTSTTSEGSTPLSIMPLSTTPVASSEASTLSTTPVDTSTPVTTSSPTNSSPTTAEVTSMPTSTAGEGSTPLTNMPVSTTPVASSEASTLSTTPVDSNTFVTSSSQASSSPATLQVTTMRMSTPSEGSSSLTTMLLSSTYVTSSEASTPSTPSVDRSTPVTTSTQSNSTPTPPEVITLPMSTPSEVSTPLTIMPVSTTSVTISEAGTASTLPVDTSTPVITSTQVSSSPVTPEGTTMPIWTPSEGSTPLTTMPVSTTRVTSSEGSTLSTPSVVTSTPVTTSTEAISSSATLDSTTMSVSMPMEISTLGTTILVSTTPVTRFPESSTPSIPSVYTSMSMTTASEGSSSPTTLEGTTTMPMSTTSERSTLLTTVLISPISVMSPSEASTLSTPPGDTSTPLLTSTKAGSFSIPAEVTTIRISITSERSTPLTTLLVSTTLPTSFPGASIASTPPLDTSTTFTPSTDTASTPTIPVATTISVSVITEGSTPGTTIFIPSTPVTSSTADVFPATTGAVSTPVITSTELNTPSTSSSSTTTSFSTTKEFTTPAMTTAAPLTYVTMSTAPSTPRTTSRGCTTSASTLSATSTPHTSTSVTTRPVTPSSESSRPSTITSHTIPPTFPPAHSSTPPTTSASSTTVNPEAVTTMTTRTKPSTRTTSFPTVTTTAVPTNTTIKSNPTSTPTVPRTTTCFGDGCQNTASRCKNGGTWDGLKCQCPNLYYGELCEEVVSSIDIGPPETISAQMELTVTVTSVKFTEELKNHSSQEFQEFKQTFTEQMNIVYSGIPEYVGVNITKLRLGSVVVEHDVLLRTKYTPEYKTVLDNATEVVKEKITKVTTQQIMINDICSDMMCFNTTGTQVQNITVTQYDPEEDCRKMAKEYGDYFVVEYRDQKPYCISPCEPGFSVSKNCNLGKCQMSLSGPQCLCVTTETHWYSGETCNQGTQKSLVYG

SEQ ID NO: 23 - protein, 407 aa, Homo sapiens
SQVSQNCHNGSYEISVLMMGNSAFAEPLKNLEDAVNEGLEIVRGRLQNAGLNVTVNATFMYSDGLIHNSGDCRSSTCEGLDLLRKISNAQRMGCVLIGPSCTYSTFQMYLDTELSYPMISAGSFGLSCDYKETLTRLMSPARKLMYFLVNFWKTNDLPFKTYSWSTSYVYKNGTETEDCFWYLNALEASVSYFSHELGFKVVLRQDKEFQDILMDHNRKSNVIIMCGGPEFLYKLKGDRAVAEDIVIILVDLFNDQYFEDNVTAPDYMKNVLVLTLSPGNSLLNSSFSRNLSPTKRDFALAYLNGILLFGHMLKIFLENGENITTPKFAHAFRNLTFEGYDGPVTLDDWGDVDSTMVLLYTSVDTKKYKVLLTYDTHVNKTYPVDMSPTFTWKNSKLPNDITGRGPQ

SEQ ID NO: 24 - protein, 264 aa, Homo sapiens
PRFMGTISDVKTNVQLLKGRVDNISTLDSEIKKNSDGMEAAGVQIQMVNESLGYVRSQFLKLKTSVEKANAQIQILTRSWEEVSTLNAQIPELKSDLEKASALNTKIRALQGSLENMSKLLKRQNDILQVVSQGWKYFKGNFYYFSLIPKTWYSAEQFCVSRNSHLTSVTSESEQEFLYKTAGGLIYWIGLTKAGMEGDWSWVDDTPFNKVQSVRFWIPGEPNNAGNNEHCGNIKAPSLQAWNDAPCDKTFLFICKRPYVPSEP

SEQ ID NO: 25 - protein, 100 aa, Homo sapiens
DGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENC

SEQ ID NO: 26 - protein, 371 aa, Homo sapiens
KKVVLGKKGDTVELTCTASQKKSIQFHWKNSNQIKILGNQGSFLTKGPSKLNDRADSRRSLWDQGNFPLIIKNLKIEDSDTYICEVEDQKEEVQLLVFGLTANSDTHLLQGQSLTLTLESPPGSSPSVQCRSPRGKNIQGGKTLSVSQLELQDSGTWTCTVLQNQKKVEFKIDIVVLAFQKASSIVYKKEGEQVEFSFPLAFTVEKLTGSGELWWQAERASSSKSWITFDLKNKEVSVKRVTQDPKLQMGKKLPLHLTLPQALPQYAGSGNLTLALEAKTGKLHQEVNLVVMRATQLQKNLTCEVWGPTSPKLMLSLKLENKEAKVSKREKAVWVLNPEAGMWQCLLSDSGQVLLESNIKVLPTWSTPVQP

SEQ ID NO: 27 - protein, 348 aa, Homo sapiens
RLSWYDPDFQARLTRSNSKCQGQLEVYLKDGWHMVCSQSWGRSSKQWEDPSQASKVCQRLNCGVPLSLGPFLVTYTPQSSIICYGQLGSFSNCSHSRNDMCHSLGLTCLEPQKTTPPTTRPPPTTTPEPTAPPRLQLVAQSGGQHCAGVVEFYSGSLGGTISYEAQDKTQDLENFLCNNLQCGSFLKHLPETEAGRAQDPGEPREHQPLPIQWKIQNSSCTSLEHCFRKIKPQKSGRVLALLCSGFQPKVQSRLVGGSSICEGTVEVRQGAQWAALCDSSSARSSLRWEEVCREQQCGSVNSYRVLDAGDPTSRGLFCPHQKLSQCHELWERNSYCKKVFVTCQDPNP

SEQ ID NO: 28 - DNA, 7902 bp, Artificial Sequence
  Synthesized
gtcgacactagtaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcctgccgcggaattcgagctcggtacctttaagaccaatgacttacaaggcagctgtagatcttagccactttttaaaagaaaaggggggactggaagggctaattcactcccaacgaagacaagatctgctttttgcttgtactgagtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtagtagttcatgtcatcttattattcagtatttataacttgcaaagaaatgaatatcagagagtgagaggaacttgtttattgcagcttataatggttacaaataaagcaatagcatcacaaatttcacaaataaagcatttttttcactgcattctagttgtggtttgtccaaactcatcaatgtatcttatcatgtctggctctagctatcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctagggacgtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtggctctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctgcaagcttaatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacggctctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgatcacgagactagcctcgacacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagaaatccactttggctcgagaagcttgatatcggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggatccgccaccatggccttaccagtgaccgccttgctcctgccgctggccttgctgctccacgccgccaggccggatatccagatgacccagagcccgagcagcctgagcgcgagcgtgggtgatcgcgtgaccattacctgcagggcaagtcaggacattagtaaatatttaaattggtatcagcagaaaccgggtaaagcgccgaaactgttaatttatcatacatcaagattacactcaggcgtgccgtcgcgttttagcggctcgggttcgggcaccgattttaccctgaccatctcgagcttgcagccggaggacttcgccacctactattgccaacagggtaatacgcttccgtacacgttcggtcagggcaccaaagtggagatcaaaggtggcggtggctcgggcggtggtgggtcgggtggcggcggatctgaggtgcagctggtggagtctgggggaggcttggtacagcctggggggtccctgagactctcctgtgcagcctctggagtgtccctgcctgattatggcgtgtcctgggtccgccaggctccagggaaggggctggagtgggtttcagtgatctggggcagcgagacaacctactacaacagcgccctgaagtcccgattcaccatctccagagacaatgccaagaactcactgtatctgcaaatgaacagcctgagagccgaggacacggctgtgtattactgtgcgaagcactactactacggcggcagctacgctatggactactggggccaaggaaccctggtcaccgtgtcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcc

SEQ ID NO: 29 - protein, 66 aa, Artificial Sequence
  Synthesized
TTTPAPRPPTPAPTIASQPLSLRPEACRPAAGGAVHTRGLDFACDIYIWAPLAGTCGVLLLSLVIT

SEQ ID NO: 30 - protein, 69 aa, Artificial Sequence
  Synthesized
TTTPAPRPPTPAPTIASQPLSLRPEACRPAAGGAVHTRGLDFACDIYIWAPLAGTCGVLLLSLVITLYC

SEQ ID NO: 31 - protein, 72 aa, Artificial Sequence
  Synthesized
AKPTTTPAPRPPTPAPTIASQPLSLRPEACRPAAGGAVHTRGLDFACDIYIWAPLAGTCGVLLLSLVITLYC

SEQ ID NO: 32 - protein, 69 aa, Artificial Sequence; identical to SEQ ID NO: 2
  Synthesized

SEQ ID NO: 33 - protein, 50 aa, Artificial Sequence
  Synthesized
AKPTTTPAPRPPTPAPTIASQPLSLRPEACRPAAGGAVHTRGLDFACDIY

SEQ ID NO: 34 - protein, 50 aa, Artificial Sequence; identical to SEQ ID NO: 33
  Synthesized

SEQ ID NO: 35 - protein, 47 aa, Artificial Sequence
  Synthesized
TTTPAPRPPTPAPTIASQPLSLRPEACRPAAGGAVHTRGLDFACDIY

SEQ ID NO: 36 - protein, 47 aa, Artificial Sequence; identical to SEQ ID NO: 35
  Synthesized

SEQ ID NO: 37 - protein, 22 aa, Artificial Sequence
  Synthesized
IWAPLAGTCGVLLLSLVITLYC

SEQ ID NO: 38 - protein, 22 aa, Artificial Sequence
  Synthesized
IWAPLAGTCGVLLLSLVITLYC

SEQ ID NO: 39 - protein, 270 aa, Artificial Sequence
  Synthesized
PEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGELFRWNVSDLGGLGCGLKNRSSEGPSSPSGKLMSPKLYVWAKDRPEIWEGEPPCLPPRDSLNQSLSQDLTMAPGSTLWLSCGVPPDSVSRGPLSWTHVHPKGPKSLLSLELKDDRPARDMWVMETGLLLPRATAQDAGKYYCHRGNLTMSFHLEITARPVLWHWLLRTGG

SEQ ID NO: 40 - protein, 19 aa, Artificial Sequence
  Synthesized
IWAPLAGTCGVLLLSLVIT

SEQ ID NO: 41 - DNA, 339 bp, Artificial Sequence
  Synthesized
agagtgaagttcagcaggagcgcagacgcccccgcgtaccagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 42 - DNA, 1689 bp, Artificial Sequence
  Synthesized
cggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggatccgccaccatggccttaccagtgaccgccttgctcctgccgctggccttgctgctccacgccgccaggccggacatccagctcacccagtccccgagctcgctgtccgcctccgtgggagatcgggtcaccatcacgtgccgcgccagccagtcgatttcctcctacctgaactggtaccaacagaagcccggaaaagccccgaagcttctcatctacgccgcctcgagcctgcagtcaggagtgccctcacggttctccggctccggttccggtactgatttcaccctgaccatttcctccctgcaaccggaggacttcgctacttactactgccagcagtcgtactccaccccctacactttcggacaaggcaccaaggtcgaaatcaagggtggcggtggctcgggcggtggtgggtcgggtggcggcggatctgaagtgcaattggtggaatcagggggaggacttgtgcagcctggaggatcgctgagactgtcatgtgccgtgtccggctttgccctgtccaaccacgggatgtcctgggtccgccgcgcgcctggaaagggcctcgaatgggtgtcgggtattgtgtacagcggtagcacctactatgccgcatccgtgaaggggagattcaccatcagccgggacaactccaggaacactctgtacctccaaatgaattcgctgaggccagaggacactgccatctactactgctccgcgcatggcggagagtccgacgtctggggacaggggaccaccgtgaccgtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 43 - DNA, 1689 bp, Homo sapiens
cggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggatccgccaccatggccttaccagtgaccgccttgctcctgccgctggccttgctgctccacgccgccaggccggacatccagctcacccagtccccgagctcgctgtccgcctccgtgggagatcgggtcaccatcacgtgccgcgccagccagtcgatttcctcctacctgaactggtaccaacagaagcccggaaaagccccgaagcttctcatctacgccgcctcgagcctgcagtcaggagtgccctcacggttctccggctccggttccggtactgatttcaccctgaccatttcctccctgcaaccggaggacttcgctacttactactgccagcagtcgtactccaccccctacactttcggacaaggcaccaaggtcgaaatcaagggtggcggtggctcgggcggtggtgggtcgggtggcggcggatctgaagtgcaattggtggaatcagggggaggacttgtgcagcctggaggatcgctgagactgtcatgtgccgtgtccggctttgccctgtccaaccacgggatgtcctgggtccgccgcgcgcctggaaagggcctcgaatgggtgtcgggtattgtgtacagcggtagcacctactatgccgcatccgtgaaggggagattcaccatcagccgggacaactccaggaacactctgtacctccaaatgaattcgctgaggccagaggacactgccatctactactgctccgcgcatggcggagagtccgacgtctggggacaggggaccaccgtgaccgtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 44 - DNA, 1689 bp, Artificial Sequence; identical to SEQ ID NO: 42
  Synthesized

SEQ ID NO: 45 - DNA, 1689 bp, Artificial Sequence; identical to SEQ ID NO: 43
  Synthesized

SEQ ID NO: 46 - protein, 106 aa, Artificial Sequence
  Synthesized
NIVMTQSPSSLSASVGDRVTITCQASQDVGTAVAWYQQKPDQSPKLLIYWTSTRHTGVPDRFTGSGSGTDFTLTISSLQPEDIATYFCHQYNSYNTFGSGTKLEIK

SEQ ID NO: 47 - protein, 120 aa, Artificial Sequence
  Synthesized
QVTLKESGPVLVKPTETLTLTCTFSGFSLSTSGMGVGWIRQAPGKGLEWVAHIWWDDDVYYNPSLKSRLTITKDASKDQVSLKLSSVTAADTAVYYCVRRRATGTGFDYWGQGTLVTVSS

SEQ ID NO: 48 - protein, 130 aa, Artificial Sequence
  Synthesized
METDTLLLWVLLLWVPGSTGDIVLTQSPALAVSLGQRATISCRASQSVSISSHDLMQWYQQKPGQQPKLLIYDAFNLASGIPVRFSGSGSGTDFTLTIDPVQADDIATYYCQQSKDDPYTFGAGTKLELK

SEQ ID NO: 49 - protein, 139 aa, Artificial Sequence
  Synthesized
MDIRLSLAFLVLFIKGVQCEVQLVESGGGLVQPGRSMKLSCAASGFTFSNYGMAWVRQAPTKGLEWVATISYDGSITYYRDSVKGRFTISRDHAKSTLYLQMNSLRSEDTATYYCTREEQYSSWYFDFWGPGIMVTVSS

SEQ ID NO: 50 - protein, 112 aa, Artificial Sequence
  Synthesized
DIVMTQSPDSLAVSLGERATINCKSSQSLLNSRTRKNYLAWYQQKPGQPPKLLIYWASTRESGVPDRFSGSGSGTDFTLTISSLQAEDVAVYYCTQSFILRTFGQGTKVEIK

SEQ ID NO: 51 - protein, 119 aa, Artificial Sequence
  Synthesized
EVQLVQSGAEVKKPGASVKVSCKASGYTFTNYYIHWVRQAPGQGLEWIGWIYPGDGNTKYNEKFKGRATLTADTSTSTAYLELSSLRSEDTAVYYCARDSYSNYYFDYWGQGTLVTVSS

SEQ ID NO: 52 - protein, 413 aa, Artificial Sequence
  Synthesized
MRPADLLQLVLLLDLPRDLGGMGCSSPPCECHQEEDFRVTCKDIQRIPSLPPSTQTLKLIETHLRTIPSHAFSNLPNISRIYVSIDVTLQQLESHSFYNLSKVTHIEIRNTRNLTYIDPDALKELPLLKFLGIFNTGLKMFPDLTKVYSTDIFFILEITDNPYMTSIPVNAFQGLCNETLTLKLYNNGFTSVQGYAFNGTKLDAVYLNKNKYLTVIDKDAFGGVYSGPSLLDVSQTSVTALPSKGLEHLKELIARNTWTLKKLPLSLSFLHLTRADLSYPSHCCAFKNQKKIRGILESLMCNESSMQSLRQRKSVNALNSPLHQEYEENLGDSIVGYKEKSKFQDTHNNAHYYVFFEEQEDEIIGFGQELKNPQEETLQAFDSHYDYTICGDSEDMVCTPKSDEFNPCEDIMG

SEQ ID NO: 53 - protein, 115 aa, Artificial Sequence
  Synthesized
EVQLLESGGGLVQPGGSLRLSCAASGFTFSSYAMNWVRQAPGKGLEWVSAILSSGGSTYYADSVKGRFTISRDNSKNTLYLQMNSLRAEDTAVYYCARYWPMDIWGQGTLVTVSS

SEQ ID NO: 54 - protein, 108 aa, Artificial Sequence
  Synthesized
EIVLTQSPGTLSLSPGERATLSCRGGQSVSSSYLAWYQQKPGQAPRLLMYDASIRATGIPDRFSGSGSGTDFTLTISRLEPEDFAVYYCQQYQSWPLTFGQGTKVEIK

SEQ ID NO: 55 - protein, 140 aa, Artificial Sequence
  Synthesized
MGWSCIILFLVATATGVHSEVQLVESGGGLMQPKGSLKLSCAASGFTFKTYALNWVRQAPGTGLEWVARIRSKSNNYTTYYADSVKDRFTISRDDSQNMLYLQMNNLKTEDTAMYYCVRPQSGTSFAYWGQGTLVTVSAA

SEQ ID NO: 56 - protein, 131 aa, Artificial Sequence
  Synthesized
MGWSCIILFLVATATGVHSNIVLTQSPASLAVSLGQRATISCRASESVDSYGNSFMHWYQQKPGQPPKLLIYLASNLESGVPARFSGSGSRTDFTLTIDPVEADDVATYYCQQNNGDPYTFGGGTKLEIIR

SEQ ID NO: 57 - protein, 120 aa, Artificial Sequence
  Synthesized
QVQLVQSGGGVVQPGKSLRLSCAASGFTFSIFAMHWVRQAPGKGLEWVATISYDGSNAFYADSVEGRFTISRDNSKDSLYLQMDSLRPEDTAVYYCVKAGDGGYDVFDSWGQGTLVTVSS

SEQ ID NO: 58 - protein, 111 aa, Artificial Sequence
  Synthesized
EIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPTFGPGTKVDIK

SEQ ID NO: 59 - DNA, 1473 bp, Artificial Sequence
  Synthesized
atggccttaccagtgaccgccttgctcctgccgctggccttgctgctccacgccgccaggccggatatccagatgacccagagcccaagctccctgtccgcctctgtgggcgacagggtgaccatcacatgccgcgccagccagacaatctggtcctacctgaactggtatcagcagagacccggcaaggcccctaatctgctgatctacgcagcatctagcctgcagtctggagtgccctcccggttctctggaagaggatccggaaccgacttcaccctgacaatctcctctctgcaggccgaggacttcgccacatactattgccagcagagctattccatccctcagacctttggccagggcacaaagctggagatcaagggcggcggcggctctggaggaggaggaagcggaggaggaggatcccaggtgcagctgcagcagagcggaccaggactggtgaagccctcccagaccctgtctctgacatgtgccatcagcggcgattccgtgagctccaacagcgccgcctggaattggatccggcagtctcccagcagaggactggagtggctgggaaggacctactatcgctccaagtggtacaacgattatgccgtgtctgtgaagagccggatcaccatcaaccctgacacatctaagaatcagttcagcctgcagctgaattccgtgaccccagaggacacagccgtgtactattgtgcaagggaggtgaccggcgacctggaggatgcctttgacatctggggccagggcaccatggtgacagtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 60 - DNA, 1446 bp, Artificial Sequence
  Synthesized
atggccttaccagtgaccgccttgctcctgccgctggccttgctgctccacgccgccaggccggacatccagctcacccagtccccgagctcgctgtccgcctccgtgggagatcgggtcaccatcacgtgccgcgccagccagtcgatttcctcctacctgaactggtaccaacagaagcccggaaaagccccgaagcttctcatctacgccgcctcgagcctgcagtcaggagtgccctcacggttctccggctccggttccggtactgatttcaccctgaccatttcctccctgcaaccggaggacttcgctacttactactgccagcagtcgtactccaccccctacactttcggacaaggcaccaaggtcgaaatcaagggtggcggtggctcgggcggtggtgggtcgggtggcggcggatctgaagtgcaattggtggaatcagggggaggacttgtgcagcctggaggatcgctgagactgtcatgtgccgtgtccggctttgccctgtccaaccacgggatgtcctgggtccgccgcgcgcctggaaagggcctcgaatgggtgtcgggtattgtgtacagcggtagcacctactatgccgcatccgtgaaggggagattcaccatcagccgggacaactccaggaacactctgtacctccaaatgaattcgctgaggccagaggacactgccatctactactgctccgcgcatggcggagagtccgacgtctggggacaggggaccaccgtgaccgtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 61 - DNA, 1467 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 62 - DNA, 3533 bp, Artificial Sequence
  Synthesized
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 63 - DNA, 3533 bp, Artificial Sequence
  Synthesized
atggccttaccagtgaccgccttgctcctgccgctggccttgctgctccacgccgccaggccggatatccagatgacccagagcccgagcagcctgagcgcgagcgtgggtgatcgcgtgaccattacctgcagggcaagtcaggacattagtaaatatttaaattggtatcagcagaaaccgggtaaagcgccgaaactgttaatttatcatacatcaagattacactcaggcgtgccgtcgcgttttagcggctcgggttcgggcaccgattttaccctgaccatctcgagcttgcagccggaggacttcgccacctactattgccaacagggtaatacgcttccgtacacgttcggtcagggcaccaaagtggagatcaaaggtggcggtggctcgggcggtggtgggtcgggtggcggcggatctgaggtgcagctggtggagtctgggggaggcttggtacagcctggggggtccctgagactctcctgtgcagcctctggagtgtccctgcctgattatggcgtgtcctgggtccgccaggctccagggaaggggctggagtgggtttcagtgatctggggcagcgagacaacctactacaacagcgccctgaagtcccgattcaccatctccagagacaatgccaagaactcactgtatctgcaaatgaacagcctgagagccgaggacacggctgtgtattactgtgcgaagcactactactacggcggcagctacgctatggactactggggccaaggaaccctggtcaccgtgtcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 64 - DNA, 3545 bp, Artificial Sequence
  Synthesized
atggccttaccagtgaccgccttgctcctgccgctggccttgctgctccacgccgccaggccggatatccagatgacccagagcccaagctccctgtccgcctctgtgggcgacagggtgaccatcacatgccgcgccagccagacaatctggtcctacctgaactggtatcagcagagacccggcaaggcccctaatctgctgatctacgcagcatctagcctgcagtctggagtgccctcccggttctctggaagaggatccggaaccgacttcaccctgacaatctcctctctgcaggccgaggacttcgccacatactattgccagcagagctattccatccctcagacctttggccagggcacaaagctggagatcaagggcggcggcggctctggaggaggaggaagcggaggaggaggatcccaggtgcagctgcagcagagcggaccaggactggtgaagccctcccagaccctgtctctgacatgtgccatcagcggcgattccgtgagctccaacagcgccgcctggaattggatccggcagtctcccagcagaggactggagtggctgggaaggacctactatcgctccaagtggtacaacgattatgccgtgtctgtgaagagccggatcaccatcaaccctgacacatctaagaatcagttcagcctgcagctgaattccgtgaccccagaggacacagccgtgtactattgtgcaagggaggtgaccggcgacctggaggatgcctttgacatctggggccagggcaccatggtgacagtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 65 - DNA, 3518 bp, Artificial Sequence
  Synthesized
atggccttaccagtgaccgccttgctcctgccgctggccttgctgctccacgccgccaggccggacatccagctcacccagtccccgagctcgctgtccgcctccgtgggagatcgggtcaccatcacgtgccgcgccagccagtcgatttcctcctacctgaactggtaccaacagaagcccggaaaagccccgaagcttctcatctacgccgcctcgagcctgcagtcaggagtgccctcacggttctccggctccggttccggtactgatttcaccctgaccatttcctccctgcaaccggaggacttcgctacttactactgccagcagtcgtactccaccccctacactttcggacaaggcaccaaggtcgaaatcaagggtggcggtggctcgggcggtggtgggtcgggtggcggcggatctgaagtgcaattggtggaatcagggggaggacttgtgcagcctggaggatcgctgagactgtcatgtgccgtgtccggctttgccctgtccaaccacgggatgtcctgggtccgccgcgcgcctggaaagggcctcgaatgggtgtcgggtattgtgtacagcggtagcacctactatgccgcatccgtgaaggggagattcaccatcagccgggacaactccaggaacactctgtacctccaaatgaattcgctgaggccagaggacactgccatctactactgctccgcgcatggcggagagtccgacgtctggggacaggggaccaccgtgaccgtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 66 - DNA, 2994 bp, Artificial Sequence
  Synthesized
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagagccacgaacttctctctgttaaagcaagcaggagacgtggaagaaaaccccggtcctcatatgatggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 67 - DNA, 2994 bp, Artificial Sequence
  Synthesized
atggccttaccagtgaccgccttgctcctgccgctggccttgctgctccacgccgccaggccggatatccagatgacccagagcccgagcagcctgagcgcgagcgtgggtgatcgcgtgaccattacctgcagggcaagtcaggacattagtaaatatttaaattggtatcagcagaaaccgggtaaagcgccgaaactgttaatttatcatacatcaagattacactcaggcgtgccgtcgcgttttagcggctcgggttcgggcaccgattttaccctgaccatctcgagcttgcagccggaggacttcgccacctactattgccaacagggtaatacgcttccgtacacgttcggtcagggcaccaaagtggagatcaaaggtggcggtggctcgggcggtggtgggtcgggtggcggcggatctgaggtgcagctggtggagtctgggggaggcttggtacagcctggggggtccctgagactctcctgtgcagcctctggagtgtccctgcctgattatggcgtgtcctgggtccgccaggctccagggaaggggctggagtgggtttcagtgatctggggcagcgagacaacctactacaacagcgccctgaagtcccgattcaccatctccagagacaatgccaagaactcactgtatctgcaaatgaacagcctgagagccgaggacacggctgtgtattactgtgcgaagcactactactacggcggcagctacgctatggactactggggccaaggaaccctggtcaccgtgtcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagagccacgaacttctctctgttaaagcaagcaggagacgtggaagaaaaccccggtcctcatatgatggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 68 - DNA, 3009 bp, Artificial Sequence
  Synthesized
atggccttaccagtgaccgccttgctcctgccgctggccttgctgctccacgccgccaggccggatatccagatgacccagagcccaagctccctgtccgcctctgtgggcgacagggtgaccatcacatgccgcgccagccagacaatctggtcctacctgaactggtatcagcagagacccggcaaggcccctaatctgctgatctacgcagcatctagcctgcagtctggagtgccctcccggttctctggaagaggatccggaaccgacttcaccctgacaatctcctctctgcaggccgaggacttcgccacatactattgccagcagagctattccatccctcagacctttggccagggcacaaagctggagatcaagggcggcggcggctctggaggaggaggaagcggaggaggaggatcccaggtgcagctgcagcagagcggaccaggactggtgaagccctcccagaccctgtctctgacatgtgccatcagcggcgattccgtgagctccaacagcgccgcctggaattggatccggcagtctcccagcagaggactggagtggctgggaaggacctactatcgctccaagtggtacaacgattatgccgtgtctgtgaagagccggatcaccatcaaccctgacacatctaagaatcagttcagcctgcagctgaattccgtgaccccagaggacacagccgtgtactattgtgcaagggaggtgaccggcgacctggaggatgcctttgacatctggggccagggcaccatggtgacagtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagagccacgaacttctctctgttaaagcaagcaggagacgtggaagaaaaccccggtcctcatatgatggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 69 - DNA, 2982 bp, Artificial Sequence
  Synthesized
atggccttaccagtgaccgccttgctcctgccgctggccttgctgctccacgccgccaggccggacatccagctcacccagtccccgagctcgctgtccgcctccgtgggagatcgggtcaccatcacgtgccgcgccagccagtcgatttcctcctacctgaactggtaccaacagaagcccggaaaagccccgaagcttctcatctacgccgcctcgagcctgcagtcaggagtgccctcacggttctccggctccggttccggtactgatttcaccctgaccatttcctccctgcaaccggaggacttcgctacttactactgccagcagtcgtactccaccccctacactttcggacaaggcaccaaggtcgaaatcaagggtggcggtggctcgggcggtggtgggtcgggtggcggcggatctgaagtgcaattggtggaatcagggggaggacttgtgcagcctggaggatcgctgagactgtcatgtgccgtgtccggctttgccctgtccaaccacgggatgtcctgggtccgccgcgcgcctggaaagggcctcgaatgggtgtcgggtattgtgtacagcggtagcacctactatgccgcatccgtgaaggggagattcaccatcagccgggacaactccaggaacactctgtacctccaaatgaattcgctgaggccagaggacactgccatctactactgctccgcgcatggcggagagtccgacgtctggggacaggggaccaccgtgaccgtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagagccacgaacttctctctgttaaagcaagcaggagacgtggaagaaaaccccggtcctcatatgatggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 70 - protein, 244 aa, Artificial Sequence
  Synthesized
DIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSS

SEQ ID NO: 71 - protein, 116 aa, Artificial Sequence
  Synthesized
QVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSS

SEQ ID NO: 72 - protein, 113 aa, Artificial Sequence
  Synthesized
DIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELK

SEQ ID NO: 73 - protein, 12 aa, Artificial Sequence
  Synthesized
QSLLNSGDQKNY

SEQ ID NO: 74 - protein, 107 aa, Artificial Sequence
  Synthesized
DIQMTQSPSSLSASVGDRVTITCRASQDISKYLNWYQQKPGKAPKLLIYHTSRLHSGVPSRFSGSGSGTDFTLTISSLQPEDFATYYCQQGNTLPYTFGQGTKVEIK

SEQ ID NO: 75 - protein, 9 aa, Artificial Sequence
  Synthesized
QNDYSYPLT

SEQ ID NO: 76 - protein, 8 aa, Artificial Sequence
  Synthesized
GYTFTDHA

SEQ ID NO: 77 - protein, 8 aa, Artificial Sequence
  Synthesized
FSPGNTDI

SEQ ID NO: 78 - protein, 9 aa, Artificial Sequence
  Synthesized
KTSTFFFDY

SEQ ID NO: 79 - protein, 246 aa, Artificial Sequence
  Synthesized
DIVMTQAAFSNPVTLGTSASISCRSSKSLLHSNGITYFFWYLQKPGLSPQLLIYQMSNLASGVPDRFSSSGSGTDFTLRISRVEAEDVGVYYCAQNLELPPTFGGGTKLEIKRAGGGGSGGGGSGGGGSEVKLVESGGGLVQPGGSMKLSCVASGFTFSNYWMNWVRQSPEKGLEWVAEIRLKSNNYTTHYAESVKGRFTISRDDSKSSVSLQMNNLRVEDTGIYYCTRHYYFDYWGQGTTLTVSS

SEQ ID NO: 80 - protein, 117 aa, Artificial Sequence
  Synthesized
EVKLVESGGGLVQPGGSMKLSCVASGFTFSNYWMNWVRQSPEKGLEWVAEIRLKSNNYTTHYAESVKGRFTISRDDSKSSVSLQMNNLRVEDTGIYYCTRHYYFDYWGQGTTLTVSS

SEQ ID NO: 81 - protein, 114 aa, Artificial Sequence
  Synthesized
DIVMTQAAFSNPVTLGTSASISCRSSKSLLHSNGITYFFWYLQKPGLSPQLLIYQMSNLASGVPDRFSSSGSGTDFTLRISRVEAEDVGVYYCAQNLELPPTFGGGTKLEIKRA

SEQ ID NO: 82 - protein, 16 aa, Artificial Sequence
  Synthesized
RSSKSLLHSNGITYFF

SEQ ID NO: 83 - protein, 7 aa, Artificial Sequence
  Synthesized
QMSNLAS

SEQ ID NO: 84 - protein, 9 aa, Artificial Sequence
  Synthesized
AQNLELPPT

SEQ ID NO: 85 - protein, 5 aa, Artificial Sequence
  Synthesized
NYWMN

SEQ ID NO: 86 - protein, 19 aa, Artificial Sequence
  Synthesized
EIRLKSNNYTTHYAESVKG

SEQ ID NO: 87 - protein, 6 aa, Artificial Sequence
  Synthesized
HYYFDY

SEQ ID NO: 88 - protein, 4 aa, Artificial Sequence
  Synthesized
GSTA

SEQ ID NO: 89 - protein, 97 aa, Artificial Sequence
  Synthesized
CSRAARGTIGARRTGQPLKEDPSAVPVFSVDAGELDFQWREKTPEPPVPCVPEQTEAATIVFPSGMGTSSPARRGSADGPRSAQPLRPEDGHCSWPL

SEQ ID NO: 90 - protein, 17 aa, Artificial Sequence
  Synthesized
CSRAARGTIDGHCSWPL

SEQ ID NO: 91 - protein, 21 aa, Artificial Sequence
  Synthesized
VGVVGGLLGSLVLLVWVLAVI

SEQ ID NO: 92 - protein, 18 aa, Artificial Sequence
  Synthesized
GNILNVSIKICLTLSPST

SEQ ID NO: 93 - protein, 9 aa, Artificial Sequence
  Synthesized
CSRAARGTI

SEQ ID NO: 94 - protein, 80 aa, Artificial Sequence
  Synthesized
GARRTGQPLKEDPSAVPVFSVDYGELDFQWREKTPEPPVPCVPEQTEYATIVFPSGMGTSSPARRGSADGPRSAQPLRPE

SEQ ID NO: 95 - protein, 80 aa, Artificial Sequence; identical to SEQ ID NO: 94
  Synthesized

SEQ ID NO: 96 - protein, 196 aa, Artificial Sequence
  Synthesized
QLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINF

SEQ ID NO: 97 - protein, 196 aa, Artificial Sequence
  Synthesized
QLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVKENQTRNKHINPNEWWKVYPSSVTEFKFLFVSGHFKGNYKAQLTRLNHKTNCNGAVLSVEELLIGGEMIKAGTLTLEEVRRKFNNGEINF

SEQ ID NO: 98 - protein, 196 aa, Artificial Sequence
  Synthesized
QLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMERYVEENQTRNKHLNPNEWWKVYPSSVTEFKFLFVSGHFKGNYKAQLTRLNHITNCNGAVLSVEELLIGGEMIKAGTLTLEEVRRKFNNGEINF

SEQ ID NO: 99 - protein, 323 aa, Artificial Sequence [sequence omitted]

SEQ ID NO: 100 - protein, 127 aa, Artificial Sequence
  Synthesized
MNVPTQLLGLLLLWLTGGKCDIQMTQSPASLSASLEEIVTITCKASQAIDAYLSWYQQKPGKSPQLLIYDATSLADGVPSRFSGSRSGTQYSLKISRPQVDDSGIYYCLQSYSTPFTFGSGTKLEIK

SEQ ID NO: 101 - protein, 184 aa, Homo sapiens
MAPLLPIRTLPLILILLALLSPGAADFNISSLSGLLSPALTESLLVALPPCHLTGGNATLMVRRANDSKVVTSSFVVPPCRGRRELVSVVDSGAGFTVTRLSAYQVTNLVPGTKFYISYLVKKGTATESSREIPMSTLPRRNMESIGLGMARTGGMVVITVLLSVAMFLLVLGFIIALALGSRK

SEQ ID NO: 102 - protein, 909 aa, Homo sapiens
MAARPLPVSPARALLLALAGALLAPCEARGVSLWNQGRADEVVSASVGSGDLWIPVKSFDSKNHPEVLNIRLQRESKELIINLERNEGLIASSFTETHYLQDGTDVSLARNYTVILGHCYYHGHVRGYSDSAVSLSTCSGLRGLIVFENESYVLEPMKSATNRYKLFPAKKLKSVRGSCGSHHNTPNLAAKNVFPPPSQTWARRHKRETLKATKYVELVIVADNREFQRQGKDLEKVKQRLIEIANHVDKFYRPLNIRIVLVGVEVWNDMDKCSVSQDPFTSLHEFLDWRKMKLLPRKSHDNAQLVSGVYFQGTTIGMAPIMSMCTADQSGGIVMDHSDNPLGAAVTLAHELGHNFGMNHDTLDRGCSCQMAVEKGGCIMNASTGYPFPMVFSSCSRKDLETSLEKGMGVCLFNLPEVRESFGGQKCGNRFVEEGEECDCGEPEECMNRCCNATTCTLKPDAVCAHGLCCEDCQLKPAGTACRDSSNSCDLPEFCTGASPHCPANVYLHDGHSCQDVDGYCYNGICQTHEQQCVTLWGPGAKPAPGICFERVNSAGDPYGNCGKVSKSSFAKCEMRDAKCGKIQCQGGASRPVIGTNAVSIETNIPLQQGGRILCRGTHVYLGDDMPDPGLVLAGTKCADGKICLNRQCQNISVFGVHECAMQCHGRGVCNNRKNCHCEAHWAPPFCDKFGFGGSTDSGPIRQADNQGLTIGILVTILCLLAAGFVVYLKRKTLIRLLFTNKKTTIEKLRCVRPSRPPRGFQPCQAHLGHLGKGLMRKPPDSYPPKDNPRRLLQCQNVDISRPLNGLNVPQPQSTQRVLPPLHRAPRAPSVPARPLPAKPALRQAQGTCKPNPPQKPLPADPLARTTRLTHALARTPGQWETGLRLAPLRPAPQYPHQVPRSTHTAYIK

SEQ ID NO: 103 - protein, 553 aa, Homo sapiens
MVQRLWVSRLLRHRKAQLLLVNLLTFGLEVCLAAGITYVPPLLLEVGVEEKFMTMVLGIGPVLGLVCVPLLGSASDHWRGRYGRRRPFIWALSLGILLSLFLIPRAGWLAGLLCPDPRPLELALLILGVGLLDFCGQVCFTPLEALLSDLFRDPDHCRQAYSVYAFMISLGGCLGYLLPAIDWDTSALAPYLGTQEECLFGLLTLIFLTCVAATLLVAEEAALGPTEPAEGLSAPSLSPHCCPCRARLAFRNLGALLPRLHQLCCRMPRTLRRLFVAELCSWMALMTFTLFYTDFVGEGLYQGVPRAEPGTEARRHYDEGVRMGSLGLFLQCAISLVFSLVMDRLVQRFGTRAVYLASVAAFPVAAGATCLSHSVAVVTASAALTGFTFSALQILPYTLASLYHREKQVFLPKYRGDTGGASSEDSLMTSFLPGPKPGAPFPNGHVGAGGSGLLPPPPALCGASACDVSVRVVVGEPTEARVVPGRGICLDLAILDSAFLLSQVAPSLFMGSIVQLSQSVTAYMVSAAGLGLVAIYFATQVVFDKSDLAKYSA

SEQ ID NO: 104 - protein, 418 aa, Homo sapiens
MRAAPLLLARAASLSLGFLFLLFFWLDRSVLAKELKFVTLVFRHGDRSPIDTFPTDPIKESSWPQGFGQLTQLGMEQHYELGEYIRKRYRKFLNESYKHEQVYIRSTDVDRTLMSAMTNLAALFPPEGVSIWNPILLWQPIPVHTVPLSEDQLLYLPFRNCPRFQELESETLKSEEFQKRLHPYKDFIATLGKLSGLHGQDLFGIWSKVYDPLYCESVHNFTLPSWATEDTMTKLRELSELSLLSLYGIHKQKEKSRLQGGVLVNEILNHMKRATQIPSYKKLIMYSAHDTTVSGLQMALDVYNGLLPPYASCHLTELYFEKGEYFVEMYYRNETQHEPYPLMLPGCSPSCPLERFAELVGPVIPQDWSTECMTTNSHQVLKVIFAVAFCLISAVLMVLLFIHIRRGLCWQRESYGNI

SEQ ID NO: 105 - protein, 560 aa, Homo sapiens
MKMQKGNVLLMFGLLLHLEAATNSNETSTSANTGSSVISSGASTATNSGSSVTSSGVSTATISGSSVTSNGVSIVTNSEFHTTSSGISTATNSEFSTVSSGISIATNSESSTTSSGASTATNSESSTPSSGASTATNSDSSTTSSGASTATNSDSSTTSSEASTATNSESSTTSSGASTATNSESSTVSSRASTATNSESSTTSSGASTATNSESRTTSNGAGTATNSESSTTSSGASTATNSESSTPSSGAGTATNSESSTTSSGAGTATNSESSTVSSGISTVTNSESSTPSSGANTATNSESSTTSSGANTATNSDSSTTSSGASTATNSESSTTSSGASTATNSESSTTSSGASTATNSGSSTTSSGTSTATNSESSTVSSGASTATTSESSTTSSGASTATNSESSTVSSGASTATNSESSTTSSGANTATNSGSSVTSAGSGTAALTGMHTTSHSASTAVSEAKPGGSLVPWEIFLITLVSVVAAVGLFAGLFFCVRNSLSLRNTFNTAVYHPHGLNHGLGPGPGGNHGAPHRPRWSPNWFWRRPVSSIAMEMS

SEQ ID NO: 106 - protein, 14507 aa, Homo sapiens
MLKPSGLPGSSSPTRSLMTGSRSTKATPEMDSGLTGATLSPKTSTGAIVVTEHTLPFTSPDKTLASPTSSVVGRTTQSLGVMSSALPESTSRGMTHSEQRTSPSLSPQVNGTPSRNYPATSMVSGLSSPRTRTSSTEGNFTKEASTYTLTVETTSGPVTEKYTVPTETSTTEGDSTETPWDTRYIPVKITSPMKTFADSTASKENAPVSMTPAETTVTDSHTPGRTNPSFGTLYSSFLDLSPKGTPNSRGETSLELILSTTGYPFSSPEPGSAGHSRISTSAPLSSSASVLDNKISETSIFSGQSLTSPLSPGVPEARASTMPNSAIPFSMTLSNAETSAERVRSTISSLGTPSISTKQTAETILTFHAFAETMDIPSTHIAKTLASEWLGSPGTLGGTSTSALTTTSPSTTLVSEETNTHHSTSGKETEGTLNTSMTPLETSAPGEESEMTATLVPTLGFTTLDSKIRSPSQVSSSHPTRELRTTGSTSGRQSSSTAAHGSSDILRATTSSTSKASSWTSESTAQQFSEPQHTQWVETSPSMKTERPPASTSVAAPITTSVPSVVSGFTTLKTSSTKGIWLEETSADTLIGESTAGPTTHQFAVPTGISMTGGSSTRGSQGTTHLLTRATASSETSADLTLATNGVPVSVSPAVSKTAAGSSPPGGTKPSYTMVSSVIPETSSLQSSAFREGTSLGLTPLNTRHPFSSPEPDSAGHTKISTSIPLLSSASVLEDKVSATSTFSHHKATSSITTGTPEISTKTKPSSAVLSSMTLSNAATSPERVRNATSPLTHPSPSGEETAGSVLTLSTSAETTDSPNIHPTGTLTSESSESPSTLSLPSVSGVKTTFSSSTPSTHLFTSGEETEETSNPSVSQPETSVSRVRTTLASTSVPTPVFPTMDTWPTRSAQFSSSHLVSELRATSSTSVTNSTGSALPKISHLTGTATMSQTNRDTFNDSAAPQSTTWPETSPRFKTGLPSATTTVSTSATSLSATVMVSKFTSPATSSMEATSIREPSTTILTTETTNGPGSMAVASTNIPIGKGYITEGRLDTSHLPIGTTASSETSMDFTMAKESVSMSVSPSQSMDAAGSSTPGRTSQFVDTFSDDVYHLTSREITIPRDGTSSALTPQMTATHPPSPDPGSARSTWLGILSSSPSSPTPKVTMSSTFSTQRVTTSMIMDTVETSRWNMPNLPSTTSLTPSNIPTSGAIGKSTLVPLDTPSPATSLEASEGGLPTLSTYPESTNTPSIHLGAHASSESPSTIKLTMASVVKPGSYTPLTFPSIETHIHVSTARMAYSSGSSPEMTAPGETNTGSTWDPTTYITTTDPKDTSSAQVSTPHSVRTLRTTENHPKTESATPAAYSGSPKISSSPNLTSPATKAWTITDTTEHSTQLHYTKLAEKSSGFETQSAPGPVSVVIPTSPTIGSSTLELTSDVPGEPLVLAPSEQTTITLPMATWLSTSLTEEMASTDLDISSPSSPMSTFAIFPPMSTPSHELSKSEADTSAIRNTDSTTLDQHLGIRSLGRTGDLTTVPITPLTTTWTSVIEHSTQAQDTLSATMSPTHVTQSLKDQTSIPASASPSHLTEVYPELGTQGRSSSEATTFWKPSTDTLSREIETGPTNIQSTPPMDNTTTGSSSSGVTLGIAHLPIGTSSPAETSTNMALERRSSTATVSMAGTMGLLVTSAPGRSISQSLGRVSSVLSESTTEGVTDSSKGSSPRLNTQGNTALSSSLEPSYAEGSQMSTSIPLTSSPTTPDVEFIGGSTFWTKEVTTVMTSDISKSSARTESSSATLMSTALGSTENTGKEKLRTASMDLPSPTPSMEVTPWISLTLSNAPNTTDSLDLSHGVHTSSAGTLATDRSLNTGVTRASRLENGSDTSSKSLSMGNSTHTSMTYTEKSEVSSSIHPRPETSAPGAETTLTSTPGNRAISLTLPFSSIPVEEVISTGITSGPDINSAPMTHSPITPPTIVWTSTGTIEQSTQPLHAVSSEKVSVQTQSTPYVNSVAVSASPTHENSVSSGSSTSSPYSSASLESLDSTISRRNAITSWLWDLTTSLPTTTWPSTSLSEALSSGHSGVSNPSSTTTEFPLFSAASTSAAKQRNPETETHGPQNTAASTLNTDASSVTGLSETPVGASISSEVPLPMAITSRSDVSGLTSESTANPSLGTASSAGTKLTRTISLPTSESLVSFRMNKDPWTVSIPLGSHPTTNTETSIPVNSAGPPGLSTVASDVIDTPSDGAESIPTVSFSPSPDTEVTTISHFPEKTTHSFRTISSLTHELTSRVTPIPGDWMSSAMSTKPTGASPSITLGERRTITSAAPTTSPIVLTASFTETSTVSLDNETTVKTSDILDARKTNELPSDSSSSSDLINTSIASSTMDVTKTASISPTSISGMTASSSPSLFSSDRPQVPTSTTETNTATSPSVSSNTYSLDGGSNVGGTPSTLPPFTITHPVETSSALLAWSRPVRTFSTMVSTDTASGENPTSSNSVVTSVPAPGTWTSVGSTTDLPAMGFLKTSPAGEAHSLLASTIEPATAFTPHLSAAVVTGSSATSEASLLTTSESKAIHSSPQTPTTPTSGANWETSATPESLLVVTETSDTTLTSKILVTDTILFSTVSTPPSKFPSTGTLSGASFPTLLPDTPAIPLTATEPTSSLATSFDSTPLVTIASDSLGTVPETTLTMSETSNGDALVLKTVSNPDRSIPGITIQGVTESPLHPSSTSPSKIVAPRNTTYEGSITVALSTLPAGTTGSLVFSQSSENSETTALVDSSAGLERASVMPLTTGSQGMASSGGIRSGSTHSTGTKTFSSLPLTMNPGEVTAMSEITTNRLTATQSTAPKGIPVKPTSAESGLLTPVSASSSPSKAFASLTTAPPTWGIPQSTLTFEFSEVPSLDTKSASLPTPGQSLNTIPDSDASTASSSLSKSPEKNPRARMMTSTKAISASSFQSTGFTETPEGSASPSMAGHEPRVPTSGTGDPRYASESMSYPDPSKASSAMTSTSLASKLTTLFSTGQAARSGSSSSPISLSTEKETSFLSPTASTSRKTSLFLGPSMARQPNILVHLQTSALTLSPTSTLNMSQEEPPELTSSQTIAEEEGTTAETQTLTFTPSETPTSLLPVSSPTEPTARRKSSPETWASSISVPAKTSLVETTDGTLVTTIKMSSQAAQGNSTWPAPAEETGSSPAGTSPGSPEMSTTLKIMSSKEPSISPEIRSTVRNSPWKTPETTVPMETTVEPVTLQSTALGSGSTSISHLPTGTTSPTKSPTENMLATERVSLSPSPPEAWTNLYSGTPGGTRQSLATMSSVSLESPTARSITGTGQQSSPELVSKTTGMEFSMWHGSTGGTTGDTHVSLSTSSNILEDPVTSPNSVSSLTDKSKHKTETWVSTTAIPSTVLNNKIMAAEQQTSRSVDEAYSSTSSWSDQTSGSDITLGASPDVTNTLYITSTAQTTSLVSLPSGDQGITSLTNPSGGKTSSASSVTSPSIGLETLRANVSAVKSDIAPTAGHLSQTSSPAEVSILDVTTAPTPGISTTITTMGTNSISTTTPNPEVGMSTMDSTPATERRTTSTEHPSTWSSTAASDSWTVTDMTSNLKVARSPGTISTMHTTSFLASSTELDSMSTPHGRITVIGTSLVTPSSDASAVKTETSTSERTLSPSDTTASTPISTFSRVQRMSISVPDILSTSWTPSSTEAEDVPVSMVSTDHASTKTDPNTPLSTFLFDSLSTLDWDTGRSLSSATATTSAPQGATTPQELTLETMISPATSQLPFSIGHITSAVTPAAMARSSGVTFSRPDPTSKKAEQTSTQLPTTTSAHPGQVPRSAATTLDVIPHTAKTPDATFQRQGQTALTTEARATSDSWNEKEKSTPSAPWITEMMNSVSEDTIKEVTSSSSVLRTLNTLDINLESGTTSSPSWKSSPYERIAPSESTTDKEAIHPSTNTVETTGWVTSSEHASHSTIPAHSASSKLTSPVVTTSTREQAIVSMSTTTWPESTRARTEPNSFLTIELRDVSPYMDTSSTTQTSIISSPGSTAITKGPRTEITSSKRISSSFLAQSMRSSDSPSEAITRLSNFPAMTESGGMILAMQTSPPGATSLSAPTLDTSATASWTGTPLATTQRFTYSEKTTLFSKGPEDTSQPSPPSVEETSSSSSLVPIHATTSPSNILLTSQGHSPSSTPPVTSVFLSETSGLGKTTDMSRISLEPGTSLPPNLSSTAGEALSTYEASRDTKAIHHSADTAVTNMEATSSEYSPIPGHTKPSKATSPLVTSHIMGDITSSTSVFGSSETTEIETVSSVNQGLQERSTSQVASSATETSTVITHVSSGDATTHVTKTQATFSSGTSISSPHQFITSTNTFTDVSTNPSTSLIMTESSGVTITTQTGPTGAATQGPYLLDTSTMPYLTETPLAVTPDFMQSEKTTLISKGPKDVSWTSPPSVAETSYPSSLTPFLVTTIPPATSTLQGQHTSSPVSATSVLTSGLVKTTDMLNTSMEPVTNSPQNLNNPSNEILATLAATTDIETIHPSINKAVTNMGTASSAHVLHSTLPVSSEPSTATSPMVPASSMGDALASISIPGSETTDIEGEPTSSLTAGRKENSTLQEMNSTTESNIILSNVSVGAITEATKMEVPSFDATFIPTPAQSTKFPDIFSVASSRLSNSPPMTISTHMTTTQTGSSGATSKIPLALDTSTLETSAGTPSVVTEGFAHSKITTAMNNDVKDVSQTNPPFQDEASSPSSQAPVLVTTLPSSVAFTPQWHSTSSPVSMSSVLTSSLVKTAGKVDTSLETVTSSPQSMSNTLDDISVTSAATTDIETTHPSINTVVTNVGTTGSAFESHSTVSAYPEPSKVTSPNVTTSTMEDTTISRSIPKSSKTTRTETETTSSLTPKLRETSISQEITSSTETSTVPYKELTGATTEVSRTDVTSSSSTSFPGPDQSTVSLDISTETNTRLSTSPIMTESAEITITTQTGPHGATSQDTFTMDPSNTTPQAGIHSAMTHGFSQLDVTTLMSRIPQDVSWTSPPSVDKTSSPSSFLSSPAMTTPSLISSTLPEDKLSSPMTSLLTSGLVKITDILRTRLEPVTSSLPNFSSTSDKILATSKDSKDTKEIFPSINTEETNVKANNSGHESHSPALADSETPKATTQMVITTTVGDPAPSTSMPVHGSSETTNIKREPTYFLTPRLRETSTSQESSFPTDTSFLLSKVPTGTITEVSSTGVNSSSKISTPDHDKSTVPPDTFTGEIPRVFTSSIKTKSAEMTITTQASPPESASHSTLPLDTSTTLSQGGTHSTVTQGFPYSEVTTLMGMGPGNVSWMTTPPVEETSSVSSLMSSPAMTSPSPVSSTSPQSIPSSPLPVTALPTSVLVTTTDVLGTTSPESVTSSPPNLSSITHERPATYKDTAHTEAAMHHSTNTAVTNVGTSGSGHKSQSSVLADSETSKATPLMSTTSTLGDTSVSTSTPNISQTNQIQTEPTASLSPRLRESSTSEKTSSTTETNTAFSYVPTGAITQASRTEISSSRTSISDLDRPTIAPDISTGMITRLFTSPIMTKSAEMTVTTQTTTPGATSQGILPWDTSTTLFQGGTHSTVSQGFPHSEITTLRSRTPGDVSWMTTPPVEETSSGFSLMSPSMTSPSPVSSTSPESIPSSPLPVTALLTSVLVTTTNVLGTTSPEPVTSSPPNLSSPTQERLTTYKDTAHTEAMHASMHTNTAVANVGTSISGHESQSSVPADSHTSKATSPMGITFAMGDTSVSTSTPAFFETRIQTESTSSLIPGLRDTRTSEEINTVTETSTVLSEVPTTTTTEVSRTEVITSSRTTISGPDHSKMSPYISTETITRLSTFPFVTGSTEMAITNQTGPIGTISQATLTLDTSSTASWEGTHSPVTQRFPHSEETTTMSRSTKGVSWQSPPSVEETSSPSSPVPLPAITSHSSLYSAVSGSSPTSALPVTSLLTSGRRKTIDMLDTHSELVTSSLPSASSFSGEILTSEASTNTETIHFSENTAETNMGTTNSMHKLHSSVSIHSQPSGHTPPKVTGSMMEDAIVSTSTPGSPETKNVDRDSTSPLTPELKEDSTALVMNSTTESNTVFSSVSLDAATEVSRAEVTYYDPTFMPASAQSTKSPDISPEASSSHSNSPPLTISTHKTIATQTGPSGVTSLGQLTLDTSTIATSAGTPSARTQDFVDSETTSVMNNDLNDVLKTSPFSAEEANSLSSQAPLLVTTSPSPVTSTLQEHSTSSLVSVTSVPTPTLAKITDMDTNLEPVTRSPQNLRNTLATSEATTDTHTMHPSINTAVANVGTTSSPNEFYFTVSPDSDPYKATSAVVITSTSGDSIVSTSMPRSSAMKKIESETTFSLIFRLRETSTSQKIGSSSDTSTVFDKAFTAATTEVSRTELTSSSRTSIQGTEKPTMSPDTSTRSVTMLSTFAGLTKSEERTIATQTGPHRATSQGTLTWDTSITTSQAGTHSAMTHGFSQLDLSTLTSRVPEYISGTSPPSVEKTSSSSSLLSLPAITSPSPVPTTLPESRPSSPVHLTSLPTSGLVKTTDMLASVASLPPNLGSTSHKIPTTSEDIKDTEKMYPSTNIAVTNVGTTTSEKESYSSVPAYSEPPKVTSPMVTSFNIRDTIVSTSMPGSSEITRIEMESTFSLAHGLKGTSTSQDPIVSTEKSAVLHKLTTGATETSRTEVASSRRTSIPGPDHSTESPDISTEVIPSLPISLGITESSNMTIITRTGPPLGSTSQGTFTLDTPTTSSRAGTHSMATQEFPHSEMTTVMNKDPEILSWTIPPSIEKTSFSSSLMPSPAMTSPPVSSTLPKTIHTTPSPMTSLLTPSLVMTTDTLGTSPEPTTSSPPNLSSTSHEILTTDEDTTAIEAMHPSTSTAATNVETTSSGHGSQSSVLADSEKTKATAPMDTTSTMGHTTVSTSMSVSSETTKIKRESTYSLTPGLRETSISQNASFSTDTSIVLSEVPTGTTAEVSRTEVTSSGRTSIPGPSQSTVLPEISTRTMTRLFASPTMTESAEMTIPTQTGPSGSTSQDTLTLDTSTTKSQAKTHSTLTQRFPHSEMTTLMSRGPGDMSWQSSPSLENPSSLPSLLSLPATTSPPPISSTLPVTISSSPLPVTSLLTSSPVTTTDMLHTSPELVTSSPPKLSHTSDERLTTGKDTTNTEAVHPSTNTAASNVEIPSSGHESPSSALADSETSKATSPMFITSTQEDTTVAISTPHFLETSRIQKESISSLSPKLRETGSSVETSSAIETSAVLSEVSIGATTEISRTEVTSSSRTSISGSAESTMLPEISTTRKIIKFPTSPILAESSEMTIKTQTSPPGSTSESTFTLDTSTTPSLVITHSTMTQRLPHSEITTLVSRGAGDVPRPSSLPVEETSPPSSQLSLSAMISPSPVSSTLPASSHSSSASVTSLLTPGQVKTTEVLDASAEPETSSPPSLSSTSVEILATSEVTTDTEKIHPFSNTAVTKVGTSSSGHESPSSVLPDSETTKATSAMGTISIMGDTSVSTLTPALSNTRKIQSEPASSLTTRLRETSTSEETSLATEANTVLSKVSTGATTEVSRTEAISFSRTSMSGPEQSTMSQDISIGTIPRISASSVLTESAKMTITTQTGPSESTLESTLNLNTATTPSWVETHSIVIQGFPHPEMTTSMGRGPGGVSWPSPPFVKETSPPSSPLSLPAVTSPHPVSTTFLAHIPPSPLPVTSLLTSGPATTTDILGTSTEPGTSSSSSLSTTSHERLTTYKDTAHTEAVHPSTNTGGTNVATTSSGYKSQSSVLADSSPMCTTSTMGDTSVLTSTPAFLETRRIQTELASSLTPGLRESSGSEGTSSGTKMSTVLSKVPTGATTEISKEDVTSIPGPAQSTISPDISTRTVSWFSTSPVMTESAEITMNTHTSPLGATTQGTSTLDTSSTTSLTMTHSTISQGFSHSQMSTLMRRGPEDVSWMSPPLLEKTRPSFSLMSSPATTSPSPVSSTLPESISSSPLPVTSLLTSGLAKTTDMLHKSSEPVTNSPANLSSTSVEILATSEVTTDTEKTHPSSNRTVTDVGTSSSGHESTSFVLADSQTSKVTSPMVITSTMEDTSVSTSTPGFFETSRIQTEPTSSLTLGLRKTSSSEGTSLATEMSTVLSGVPTGATAEVSRTEVTSSSRTSISGFAQLTVSPETSTETITRLPTSSIMTESAEMMIKTQTDPPGSTPESTHTVDISTTPNWVETHSTVTQRFSHSEMTTLVSRSPGDMLWPSQSSVEETSSASSLLSLPATTSPSPVSSTLVEDFPSASLPVTSLLNPGLVITTDRMGISREPGTSSTSNLSSTSHERLTTLEDTVDTEDMQPSTHTAVTNVRTSISGHESQSSVLSDSETPKATSPMGTTYTMGETSVSISTSDFFETSRIQIEPTSSLTSGLRETSSSERISSATEGSTVLSEVPSGATTEVSRTEVISSRGTSMSGPDQFTISPDISTEAITRLSTSPIMTESAESAITIETGSPGATSEGTLTLDTSTTTFWSGTHSTASPGFSHSEMTTLMSRTPGDVPWPSLPSVEEASSVSSSLSSPAMTSTSFFSTLPESISSSPHPVTALLTLGPVKTTDMLRTSSEPETSSPPNLSSTSAEILATSEVTKDREKIHPSSNTPVVNVGTVIYKHLSPSSVLADLVTTKPTSPMATTSTLGNTSVSTSTPAFPETMMTQPTSSLTSGLREISTSQETSSATERSASLSGMPTGATTKVSRTEALSLGRTSTPGPAQSTISPEISTETITRISTPLTTTGSAEMTITPKTGHSGASSQGTFTLDTSSRASWPGTHSAATHRSPHSGMTTPMSRGPEDVSWPSRPSVEKTSPPSSLVSLSAVTSPSPLYSTPSESSHSSPLRVTSLFTPVMMKTTDMLDTSLEPVTTSPPSMNITSDESLATSKATMETEAIQLSENTAVTQMGTISARQEFYSSYPGLPEPSKVTSPVVTSSTIKDIVSTTIPASSEITRIEMESTSTLTPTPRETSTSQEIHSATKPSTVPYKALTSATIEDSMTQVMSSSRGPSPDQSTMSQDISTEVITRLSTSPIKTESTEMTITTQTGSPGATSRGTLTLDTSTTFMSGTHSTASQGFSHSQMTALMSRTPGDVPWLSHPSVEEASSASFSLSSPVMTSSSPVSSTLPDSIHSSSLPVTSLLTSGLVKTTELLGTSSEPETSSPPNLSSTSAEILAITEVTTDTEKLEMTNVVTSGYTHESPSSVLADSVTTKATSSMGITYPTGDTNVLTSTPAFSDTSRIQTKSKLSLTPGLMETSISEETSSATEKSTVLSSVPTGATTEVSRTEAISSSRTSIPGPAQSTMSSDTSMETITRISTPLTRKESTDMAITPKTGPSGATSQGTFTLDSSSTASWPGTHSATTQRFPQSVVTTPMSRGPEDVSWPSPLSVEKNSPPSSLVSSSSVTSPSPLYSTPSGSSHSSPVPVTSLFTSIMMKATDMLDASLEPETTSAPNMNITSDESLAASKATTETEAIHVFENTAASHVETTSATEELYSSSPGFSEPTKVISPVVTSSSIRDNMVSTTMPGSSGITRIEIESMSSLTPGLRETRTSQDITSSTETSTVLYKMPSGATPEVSRTEVMPSSRTSIPGPAQSTMSLDISDEVVTRLSTSPIMTESAEITITTQTGYSLATSQVTLPLGTSMTFLSGTHSTMSQGLSHSEMTNLMSRGPESLSWTSPRFVETTRSSSSLTSLPLTTSLSPVSSTLLDSSPSSPLPVTSLILPGLVKTTEVLDTSSEPKTSSSPNLSSTSVEIPATSEIMTDTEKIHPSSNTAVAKVRTSSSVHESHSSVLADSETTITIPSMGITSAVDDTTVFTSNPAFSETRRIPTEPTFSLTPGFRETSTSEETTSITETSAVLYGVPTSATTEVSMTEIMSSNRIHIPDSDQSTMSPDIITEVITRLSSSSMMSESTQMTITTQKSSPGATAQSTLTLATTTAPLARTHSTVPPRFLHSEMTTLMSRSPENPSWKSSLFVEKTSSSSSLLSLPVTTSPSVSSTLPQSIPSSSFSVTSLLTPGMVKTTDTSTEPGTSLSPNLSGTSVEILAASEVTTDTEKIHPSSSMAVTNVGTTSSGHELYSSVSIHSEPSKATYPVGTPSSMAETSISTSMPANFETTGFEAEPFSHLTSGFRKTNMSLDTSSVTPTNTPSSPGSTHLLQSSKTDFTSSAKTSSPDWPPASQYTEIPVDIITPFNASPSITESTGITSFPESRFTMSVTESTHHLSTDLLPSAETISTGTVMPSLSEAMTSFATTGVPRAISGSGSPFSRTESGPGDATLSTIAESLPSSTPVPFSSSTFTTTDSSTIPALHEITSSSATPYRVDTSLGTESSTTEGRLVMVSTLDTSSQPGRTSSSPILDTRMTESVELGTVTSAYQVPSLSTRLTRTDGIMEHITKIPNEAAHRGTIRPVKGPQTSTSPASPKGLHTGGTKRMETTTTALKTTTTALKTTSRATLTTSVYTPTLGTLTPLNASMQMASTIPTEMMITTPYVFPDVPETTSSLATSLGAETSTALPRTTPSVFNRESETTASLVSRSGAERSPVIQTLDVSSSEPDTTASWVIHPAETIPTVSKTTPNFFHSELDTVSSTATSHGADVSSAIPTNISPSELDALTPLVTISGTDTSTTFPTLTKSPHETETRTTWLTHPAETSSTIPRTIPNFSHHESDATPSIATSPGAETSSAIPIMTVSPGAEDLVTSQVTSSGTDRNMTIPTLTLSPGEPKTIASLVTHPEAQTSSAIPTSTISPAVSRLVTSMVTSLAAKTSTTNRALTNSPGEPATTVSLVTHPAQTSPTVPWTTSIFFHSKSDTTPSMTTSHGAESSSAVPTPTVSTEVPGVVTPLVTSSRAVISTTIPILTLSPGEPETTPSMATSHGEEASSAIPTPTVSPGVPGVVTSLVTSSRAVTSTTIPILTFSLGEPETTPSMATSHGTEAGSAVPTVLPEVPGMVTSLVASSRAVTSTTLPTLTLSPGEPETTPSMATSHGAEASSTVPTVSPEVPGVVTSLVTSSSGVNSTSIPTLILSPGELETTPSMATSHGAEASSAVPTPTVSPGVSGVVTPLVTSSRAVTSTTIPILTLSSSEPETTPSMATSHGVEASSAVLTVSPEVPGMVTSLVTSSRAVTSTTIPTLTISSDEPETTTSLVTHSEAKMISAIPTLAVSPTVQGLVTSLVTSSGSETSAFSNLTVASSQPETIDSWVAHPGTEASSVVPTLTVSTGEPFTNISLVTHPAESSSTLPRTTSRFSHSELDTMPSTVTSPEAESSSAISTTISPGIPGVLTSLVTSSGRDISATFPTVPESPHESEATASWVTHPAVTSTTVPRTTPNYSHSEPDTTPSIATSPGAEATSDFPTITVSPDVPDMVTSQVTSSGTDTSITIPTLTLSSGEPETTTSFITYSETHTSSAIPTLPVSPGASKMLTSLVISSGTDSTTTFPTLTETPYEPETTAIQLIHPAETNTMVPRTTPKFSHSKSDTTLPVAITSPGPEASSAVSTTTISPDMSDLVTSLVPSSGTDTSTTFPTLSETPYEPETTATWLTHPAETSTTVSGTIPNFSHRGSDTAPSMVTSPGVDTRSGVPTTTIPPSIPGVVTSQVTSSATDTSTAIPTLTPSPGEPETTASSATHPGTQTGFTVPIRTVPSSEPDTMASWVTHPPQTSTPVSRTTSSFSHSSPDATPVMATSPRTEASSAVLTTISPGAPEMVTSQITSSGAATSTTVPTLTHSPGMPETTALLSTHPRTETSKTFPASTVFPQVSETTASLTIRPGAETSTALPTQTTSSLFTLLVTGTSRVDLSPTASPGVSAKTAPLSTHPGTETSTMIPTSTLSLGLLETTGLLATSSSAETSTSTLTLTVSPAVSGLSSASITTDKPQTVTSWNTETSPSVTSVGPPEFSRTVTGTTMTLIPSEMPTPPKTSHGEGVSPTTILRTTMVEATNLATTGSSPTVAKTTTTFNTLAGSLFTPLTTPGMSTLASESVTSRTSYNHRSWISTTSSYNRRYWTPATSTPVTSTFSPGISTSSIPSSTAATVPFMVPFTLNFTITNLQYEEDMRHPGSRKFNATERELQGLLKPLFRNSSLEYLYSGCRLASLRPEKDSSATAVDAICTHRPDPEDLGLDRERLYWELSNLTNGIQELGPYTLDRNSLYVNGFTHRSSMPTTSTPGTSTVDVGTSGTPSSSPSPTTAGPLLMPFTLNFTITNLQYEEDMRRTGSRKFNTMESVLQGLLKPLFKNTSVGPLYSGCRLTLLRPEKDGAATGVDAICTHRLDPKSPGLNREQLYWELSKLTNDIEELGPYTLDRNSLYVNGFTHQSSVSTTSTPGTSTVDLRTSGTPSSLSSPTIMAAGPLLVPFTLNFTITNLQYGEDMGHPGSRKFNTTERVLQGLLGPIFKNTSVGPLYSGCRLTSLRSEKDGAATGVDAICIHHLDPKSPGLNRERLYWELSQLTNGIKELGPYTLDRNSLYVNGFTHRTSVPTSSTPGTSTVDLGTSGTPFSLPSPATAGPLLVLFTLNFTITNLKYEEDMHRPGSRKFNTTERVLQTLLGPMFKNTSVGLLYSGCRLTLLRSEKDGAATGVDAICTHRLDPKSPGVDREQLYWELSQLTNGIKELGPYTLDRNSLYVNGFTHWIPVPTSSTPGTSTVDLGSGTPSSLPSPTTAGPLLVPFTLNFTITNLKYEEDMHCPGSRKFNTTERVLQSLLGPMFKNTSVGPLYSGCRLTLLRSEKDGAATGVDAICTHRLDPKSPGVDREQLYWELSQLTNGIKELGPYTLDRNSLYVNGFTHQTSAPNTSTPGTSTVDLGTSGTPSSLPSPTSAGPLLVPFTLNFTITNLQYEEDMHHPGSRKFNTTERVLQGLLGPMFKNTSVGLLYSGCRLTLLRPEKNGAATGMDAICSHRLDPKSPGLNREQLYWELSQLTHGIKELGPYTLDRNSLYVNGFTHRSSVAPTSTPGTSTVDLGTSGTPSSLPSPTTAVPLLVPFTLNFTITNLQYGEDMRHPGSRKFNTTERVLQGLLGPLFKNSSVGPLYSGCRLISLRSEKDGAATGVDAICTHHLNPQSPGLDREQLYWQLSQMTNGIKELGPYTLDRNSLYVNGFTHRSSGLTTSTPWTSTVDLGTSGTPSPVPSPTTTGPLLVPFTLNFTITNLQYEENMGHPGSRKFNITESVLQGLLKPLFKSTSVGPLYSGCRLTLLRPEKDGVATRVDAICTHRPDPKIPGLDRQQLYWELSQLTHSITELGPYTLDRDSLYVNGFTQRSSVPTTSTPGTFTVQPETSETPSSLPGPTATGPVLLPFTLNFTITNLQYEEDMRRPGSRKFNTTERVLQGLLMPLFKNTSVSSLYSGCRLTLLRPEKDGAATRVDAVCTHRPDPKSPGLDRERLYWKLSQLTHGITELGPYTLDRHSLYVNGFTHQSSMTTTRTPDTSTMHLATSRTPASLSGPMTASPLLVLFTINFTITNLRYEENMHHPGSRKFNTTERVLQGLLRPVFKNTSVGPLYSGCRLTLLRPKKDGAATKVDAICTYRPDPKSPGLDREQLYWELSQLTHSITELGPYTLDRDSLYVNGFTQRSSVPTTSIPGTPTVDLGTSGTPVSKPGPSAASPLLVLFTLNFTITNLRYEENMQHPGSRKFNTTERVLQGLLRSLFKSTSVGPLYSGCRLTLLRPEKDGTATGVDAICTHHPDPKSPRLDREQLYWELSQLTHNITELGPYALDNDSLFVNGFTHRSSVSTTSTPGTPTVYLGASKTPASIFGPSAASHLLILFTLNFTITNLRYEENMWPGSRKFNTTERVLQGLLRPLFKNTSVGPLYSGCRLTLLRPEKDGEATGVDAICTHRPDPTGPGLDREQLYLELSQLTHSITELGPYTLDRDSLYVNGFTHRSSVPTTSTGVVSEEPFTLNFTINNLRYMADMGQPGSLKFNITDNVMQHLLSPLFQRSSLGARYTGCRVIALRSVKNGAETRVDLLCTYLQPLSGPGLPIKQVFHELSQQTHGITRLGPYSLDKDSLYLNGYNEPGPDEPPTTPKPATTFLPPLSEATTAMGYHLKTLTLNFTISNLQYSPDMGKGSATFNSTEGVLQHLLRPLFQKSSMGPFYLGCQLISLRPEKDGAATGVDTTCTYHPDPVGPGLDIQQLYWELSQLTHGVTQLGFYVLDRDSLFINGYAPQNLSIRGEYQINFHIVNWNLSNPDPTSSEYITLLRDIQDKVTTLYKGSQLHDTFRFCLVTNLTMDSVLVTVKALFSSNLDPSLVEQVFLDKTLNASFHWLGSTYQLVDIHVTEMESSVYQPTSSSSTQHFYLNFTITNLPYSQDKAQPGTTNYQRNKRNIEDALNQLFRNSSIKSYFSDCQVSTFRSVPNRHHTGVDSLCNFSPLARRVDRVAIYEEFLRMTRNGTQLQNFTLDRSSVLVDGYSPNRNEPLTGNSDLPFWAVILIGLAGLLGVITCLICGVLVTTRRRKKEGEYNVQQQCPGYYQSHLDLEDLQ

SEQ ID NO: 107 - protein, 267 aa, Homo sapiens
MMSSKPTSHAEVNETIPNPYPPSSFMAPGFQQPLGSINLENQAQGAQRAQPYGITSPGIFASSQPGQGNIQMINPSVGTAVMNFKEEAKALGVIQIMVGLMHIGFGIVLCLISFSFREVLGFASTAVIGGYPFWGGLSFIISGSLSVSASKELSRCLVKGSLGMNIVSSILAFIGVILLLVDMCINGVAGQDYWAVLSGKGISATLMIFSLLEFFVACATAHFANQANTTTNMSVLVIPNMYESNPVTPASSSAPPRCNNYSANAPK

SEQ ID NO: 108 - protein, 535 aa, Homo sapiens
MLGPCMLLLLLLLGLRLQLSLGIIPVEEENPDFWNREAAEALGAAKKLQPAQTAAKNLIIFLGDGMGVSTVTAARILKGQKKDKLGPEIPLAMDRFPYVALSKTYNVDKHVPDSGATATAYLCGVKGNFQTIGLSAAARFNQCNTTRGNEVISVMNRAKKAGKSVGVVTTTRVQHASPAGTYAHTVNRNWYSDADVPASARQEGCQDIATQLISNMDIDVILGGGRKYMFRMGTPDPEYPDDYSQGGTRLDGKNLVQEWLAKRQGARYVWNRTELMQASLDPSVTHLMGLFEPGDMKYEIHRDSTLDPSLMEMTEAALRLLSRNPRGFFLFVEGGRIDHGHHESRAYRALTETIMFDDAIERAGQLTSEEDTLSLVTADHSHVFSFGGYPLRGSSIFGLAPGKARDRKAYTVLLYGNGPGYVLKDGARPDVTESESGSPEYRQQSAVPLDEETHAGEDVAVFARGPQAHLVHGVQEQTFIAHVMAFAACLEPYTACDLAPPAGTTDAAHPGRSVVPALLPLLAGTLLLLETATAP

SEQ ID NO: 109 - protein, 520 aa, Homo sapiens
MEFHNGGHVSGIGGFLVSLTSRMKPHTLAVTPALIFAITVATIGSFQFGYNTGVINAPETIIKEFINKTLTDKANAPPSEVLLTNLWSLSVAIFSVGGMIGSFSVGLFVNRFGRRNSMLIVNLLAATGGCLMGLCKIAESVEMLILGRLVIGLFCGLCTGFVPMYIGEISPTALRGAFGTLNQLGIVIGILVAQIFGLELILGSEELWPVLLGFTILPAILQSAALPCCPESPRFLLINRKKEENATRILQRLWGTQDVSQDIQEMKDESARMSQEKQVTVLELFRVSSYRQPIIISIVLQLSQQLSGINAVFYYSTGIFKDAGVQQPIYATISAGVVNTIFTLLSLFLVERAGRRTLHMIGLGGMAFCSTLMTVSLLLKNHYNGMSFVCIGAILVFVACFEIGPGPIPWFIVAELFSQGPRPAAMAVAGCSNWTSNFLVGLLFPSAAYYLGAYVFIIFTGFLITFLAFTFFKVPETRGRTFEDITRAFEGQAHGADRSGKDGVMGMNSIEPAKETTTNV

SEQ ID NO: 110 - protein, 221 aa, Homo sapiens
MLTLEDKDMKGFSWAIVPALTSLGYLIILVVSIFPFWVRLTNEESHEVFFSGLFENCFNAKCWKPRPLSIYIILGRVFLLSAVFLAFVTTFIMMPFASEFFPRTWKQNFVLACISFFTGACAFLALVLHALEIKALRMKLGPLQFSVLWPYYVLGFGIFLFIVAGTICLIQEMVCPCWHLLSTSQSMEEDHGSLYLDNLESLGGEPSSVQKETQVTAETVI

SEQ ID NO: 111 - protein, 538 aa, Homo sapiens
MGLLLLVLILTPSLAAYRHPDFPLLEKAQQLLQSTGSPYSTNCWLCTSSSTETPGTAYPASPREWTSIEAELHISYRWDPNLKGLMRPANSLLSTVKQDFPDIRQKPPIFGPIFTNINLMGIAPICVMAKRKNGTNVGTLPSTVCNVTFTVDSNQQTYQTYTHNQFRHQPRFPKPPNITFPQGTLLDKSSRFCQGRPSSCSTRNFWFRPADYNQCLQISNLSSTAEWVLLDQTRNSLFWENKTKGANQSQTPCVQVLAGMTIATSYLGISAVSEFFGTSLTPLFHFHISTCLKTQGAFYICGQSIHQCLPSNWTGTCTIGYVTPDIFIAPGNLSLPIPIYGNSPLPRVRRAIHFIPLLAGLGILAGTGTGIAGITKASLTYSQLSKEIANNIDTMAKALTTMQEQIDSLAAVVLQNRRGLDMLTAAQGGICLALDEKCCFWVNQSGKVQDNIRQLLNQASSLRERATQGWLNWEGTWKWFSWVLPLTGPLVSLLLLLLFGPCLLNLITQFVSSRLQAIKLQTNLSAGRHPRNIQESPF

SEQ ID NO: 112 - protein, 1017 aa, Homo sapiens
MVFSVRQCGHVGRTEEVLLTFKIFLVIICLHVVLVTSLEEDTDNSSLSPPPAKLSVVSFAPSSNGTPEVETTSLNDVTLSLLPSNETEKTKITIVKTFNASGVKPQRNICNLSSICNDSAFFRGEIMFQYDKESTVPQNQHITNGTLTGVLSLSELKRSELNKTLQTLSETYFIMCATAEAQSTLNCTFTIKLNNTMNACAVIAALERVKIRPMEHCCCSVRIPCPSSPEELEKLQCDLQDPIVCLADHPRGPPFSSSQSIPVVPRATVLSQVPKATSFAEPPDYSPVTHNVPSPIGEIQPLSPQPSAPIASSPAIDMPPQSETISSPMPQTHVSGTPPPVKASFSSPTVSAPANVNTTSAPPVQTDIVNTSSISDLENQVLQMEKALSLGSLEPNLAGEMINQVSRLLHSPPDMLAPLAQRLLKVVDDIGLQLNFSNTTISLTSPSLALAVIRVNASSFNTTTFVAQDPANLQVSLETQAPENSIGTITLPSSLMNNLPAHDMELASRVQFNFFETPALFQDPSLENLSLISYVISSSVANLTVRNLTRNVTVTLKHINPSQDELTVRCVFWDLGRNGGRGGWSDNGCSVKDRRLNETICTCSHLTSFGVLLDLSRTSVLPAQMMALTFITYIGCGLSSIFLSVTLVTYIAFEKIRRDYPSKILIQLCAALLLLNLVFLLDSWIALYKMQGLCISVAVFLHYFLLVSFTWMGLEAFHMYLALVKVFNTYIRKYILKFCIVGWGVPAVVVTIILTISPDNYGLGSYGKFPNGSPDDFCWINNNAVFYITVVGYFCVIFLLNVSMFIVVLVQLCRIKKKKQLGAQRKTSIQDLRSIAGLTFLLGITWGFAFFAWGPVNVTFMYLFAIFNTLQGFFIFIFYCVAKENVRKQWRRYLCCGKLRLAENSDWSKTATNGLKKQTVNQGVSSSSNSLQSSSNSTNSTTLLVNNDCSVHASGNGNASTERNGVSFSVQNGDVCLHDFTGKQHMFNEKEDSCNGKGRMALRRTSKRGSLHFIEQM

SEQ ID NO: 113 - protein, 775 aa, Homo sapiens
MEPPYSLTAHYDEFQEVKYVSRCGAGGARGASLPPGFPLGAARSATGARSGLPRWNRREVCLLSGLVFAAGLCAILAAMLALKYLGPVAAGGGACPEGCPERKAFARAARFLAANLDASIDPCQDFYSFACGGWLRRHAIPDDKLTYGTIAAIGEQNEERLRRLLARPGGGPGGAAQRKVRAFFRSCLDMREIERLGPRPMLEVIEDCGGWDLGGAEERPGVAARWDLNRLLYKAQGVYSAAALFSLTVSLDDRNSSRYVIRIDQDGLTLPERTLYLAQDEDSEKILAAYRVFMERVLSLLGADAVEQKAQEILQVEQQLANITVSEHDDLRRDVSSMYNKVTLGQLQKITPHLRWKWLLDQIFQEDFSEEEEVVLLATDYMQQVSQLIRSTPHRVLHNYLVWRVVVVLSEHLSPPFREALHELAQEMEGSDKPQELARVCLGQANRHFGMALGALFVHEHFSAASKAKVQQLVEDIKYILGQRLEELDWMDAETRAAARAKLQYMMVMVGYPDFLLKPDAVDKEYEFEVHEKTYFKNILNSIRFSIQLSVKKIRQEVDKSTWLLPPQALNAYYLPNKNQMVFPAGILQPTLYDPDFPQSLNYGGIGTIIGHELTHGYDDWGGQYDRSGNLLHWWTEASYSRFLRKAECIVRLYDNFTVYNQRVNGKHTLGENIADMGGLKLAYHAYQKWVREHGPEHPLPRLKYTHDQLFFIAFAQNWCIKRRSQSIYLQVLTDKHAPEHYRVLGSVSQFEEFGRAFHCPKDSPMNPAHKCSVW

SEQ ID NO: 114 - protein, 529 aa, Homo sapiens
MGPSCPVFLSFTKLSLWWLLLTPAGGEEAKRPPPRAPGDPLSSPSPTALPQGGSHTETEDRLFKHLFRGYNRWARPVPNTSDVVIVRFGLSIAQLIDVDEKNQMMTTNVWLKQEWSDYKLRWNPTDFGNITSLRVPSEMIWIPDIVLYNNADGEFAVTHMTKAHLFSTGTVHWVPPAIYKSSCSIDVTFFPFDQQNCKMKFGSWTYDKAKIDLEQMEQTVDLKDYWESGEWAIVNATGTYNSKKYDCCAEIYPDVTYAFVIRRLPLFYTINLIIPCLLISCLTVLVFYLPSDCGEKITLCISVLLSLTVFLLLITEIIPSTSLVIPLIGEYLLFTMIFVTLSIVITVFVLNVHHRSPSTHTMPHWVRGALLGCVPRWLLMNRPPPPVELCHPLRLKLSPSYHWLESNVDAEEREVVVEEEDRWACAGHVAPSVGTLCSHGHLHSGASGPKAEALLQEGELLLSPHMQKALEGVHYIADHLRSEDADSSVKEDWKYVAMVIDRIFLWLFIIVCFLGTIGLFLPPFLAGMI

SEQ ID NO: 115 - protein, 537 aa, Homo sapiens
MPHLMERMVGSGLLWLALVSCILTQASAVQRGYGNPIEASSYGLDLDCGAPGTPEAHVCFDPCQNYTLLDEPFRSTENSAGSQGCDKNMSGWYRFVGEGGVRMSETCVQVHRCQTDAPMWLNGTHPALGDGITNHTACAHWSGNCCFWKTEVLVKACPGGYHVYRLEGTPWCNLRYCTVPRDPSTVEDKCEKACRPEEECLALNSTWGCFCRQDLNSSDVHSLQPQLDCGPREIKVKVDKCLLGGLGLGEEVIAYLRDPNCSSILQTEERNWVSVTSPVQASACRNILERNQTHAIYKNTLSLVNDFIIRDTILNINFQCAYPLDMKVSLQAALQPIVSSLNVSVDGNGEFIVRMALFQDQNYTNPYEGDAVELSVESVLYVGAILEQGDTSRFNLVLRNCYATPTEDKADLVKYFIIRNSCSNQRDSTIHVEENGQSSESRFSVQMFMFAGHYDLVFLHCEIHLCDSLNEQCQPSCSRSQVRSEVPAIDLARVLDLGPITRRGAQSPGVMNGTPSTAGFLVAWPMVLLTVLLAWLF

SEQ ID NO: 116 - protein, 426 aa, Homo sapiens
MGPLPAPSCTQRITWKGLLLTASLLNFWNPPTTAEVTIEAQPPKVSEGKDVLLLVHNLPQNLPGYFWYKGEMTDLYHYIISYIVDGKIIIYGPAYSGRETVYSNASLLIQNVTRKDAGTYTLHIIKRGDETREEIRHFTFTLYLETPKPYISSSNLNPREAMEAVRLICDPETLDASYLWWMNGQSLPVTHRLQLSKTNRTLYLFGVTKYIAGPYECEIRNPVSASRSDPVTLNLLPKLPIPYITINNLNPRENKDVLAFTCEPKSENYTYIWWLNGQSLPVSPGVKRPIENRILILPSVTRNETGPYQCEIRDRYGGLRSNPVILNVLYGPDLPRIYPSFTYYRSGENLDLSCFTESNPPAEYFWTINGKFQQSGQKLFIPQITRNHSGLYACSVHNSATGKEISKSMTVKVSGPCHGDLTESQS

SEQ ID NO: 117 - protein, 328 aa, Homo sapiens
MEKSIWLLACLAWVLPTGSFVRTKIDTTENLLNTEVHSSPAQRWSMQVPPEVSAEAGDAAVLPCTFTHPHRHYDGPLTAIWRAGEPYAGPQVFRCAAARGSELCQTALSLHGRFRLLGNPRRNDLSLRVERLALADDRRYFCRVEFAGDVHDRYESRHGVRLHVTAAPRIVNISVLPSPAHAFRALCTAEGEPPPALAWSGPALGNSLAAVRSPREGHGHLVTAELPALTHDGRYTCTAANSLGRSEASVYLFRFHGASGASTVALLLGALGFKALLLLGVLAARAARRRPEHLDTPDTPPRSQAQESNYENLSQMNPRSPPATMCSP

SEQ ID NO: 118 - protein, 620 aa, Homo sapiens
MSKSKCSVGLMSSVVAPAKEPNAVGPKEVELILVKEQNGVQLTSSTLTNPRQSPVEAQDRETWGKKIDFLLSVIGFAVDLANVWRFPYLCYKNGGGAFLVPYLLFMVIAGMPLFYMELALGQFNREGAAGVWKICPILKGVGFTVILISLYVGFFYNVIIAWALHYLFSSFTTELPWIHCNNSWNSPNCSDAHPGDSSGDSSGLNDTFGTTPAAEYFERGVLHLHQSHGIDDLGPPRWQLTACLVLVIVLLYFSLWKGVKTSGKVVWITATMPYVVLTALLLRGVTLPGAIDGIRAYLSVDFYRLCEASVWIDAATQVCFSLGVGFGVLIAFSSYNKFTNNCYRDAIVTTSINSLTSFSSGFVVFSFLGYMAQKHSVPIGDVAKDGPGLIFIIYPEAIATLPLSSAWAVVFFIMLLTLGIDSAMGGMESVITGLIDEFQLLHRHRELFTLFIVLATFLLSLFCVTNGGIYVFTLLDHFAAGTSILFGVLIEAIGVAWFYGVGQFSDDIQQMTGQRPSLYWRLCWKLVSPCFLLFVVVVSIVTFRPPHYGAYIFPDWANALGWVIATSSMAMVPIYAAYKFCSLPGSFREKLAYAIAPEKDRELVDRGEVRQFTLRHWLKV

SEQ ID NO: 119 - protein, 398 aa, Homo sapiens
MHTVATSGPNASWGAPANASGCPGCGANASDGPVPSPRAVDAWLVPLFFAALMLLGLVGNSLVIYVICRHKPMRTVTNFYIANLAATDVTFLLCCVPFTALLYPLPGWVLGDFMCKFVNYIQQVSVQATCATLTAMSVDRWYVTVFPLRALHRRTPRLALAVSLSIWVGSAAVSAPVLALHRLSPGPRAYCSEAFPSRALERAFALYNLLALYLLPLLATCACYAAMLRHLGRVAVRPAPADSALQGQVLAERAGAVRAKVSRLVAAVVLLFAACWGPIQLFLVLQALGPAGSWHPRSYAAYALKTWAHCMSYSNSALNPLLYAFLGSHFRQAFRRVCPCAPRRPRRPRRPGPSDPAAPHAELLRLGSHPAPARAQKPGSSGLAARGLCVLGEDNAPL

SEQ ID NO: 120 - protein, 431 aa, Homo sapiens
MQALNITPEQFSRLLRDHNLTREQFIALYRLRPLVYTPELPGRAKLALVLTGVLIFALALFGNALVFYVVTRSKAMRTVTNIFICSLALSDLLITFFCIPVTMLQNISDNWLGGAFICKMVPFVQSTAVVTEILTMTCIAVERHQGLVHPFKMKWQYTNRRAFTMLGVVWLVAVIVGSPMWHVQQLEIKYDFLYEKEHICCLEEWTSPVHQKIYTTFILVILFLLPLMVMLILYSKIGYELWIKKRVGDGSVLRTIHGKEMSKIARKKKRAVIMMVTVVALFAVCWAPFHVVHMMIEYSNFEKEYDDVTIKMIFAIVQIIGFSNSICNPIVYAFMNENFKKNVLSAVCYCIVNKTFSPAQRHGNSGITMMRKKAKFSLRENPVEETKGEAFSDGNIEVKLCEQTEEKKKLKRHLALFRSELAENSPLDSGH

SEQ ID NO: 121 - protein, 335 aa, Homo sapiens
MESSFSFGVILAVLASLIIATNTLVAVAVLLLIHKNDGVSLCFTLNLAVADTLIGVAISGLLTDQLSSPSRPTQKTLCSLRMAFVTSSAAASVLTVMLITFDRYLAIKQPFRYLKIMSGFVAGACIAGLWLVSYLIGFLPLGIPMFQQTAYKGQCSFFAVFHPHFVLTLSCVGFFPAMLLFVFFYCDMLKIASMHSQQIRKMEHAGAMAGGYRSPRTPSDFKALRTVSVLIGSFALSWTPFLITGIVQVACQECHLYLVLERYLWLLGVGNSLLNPLIYAYWQKEVRLQLYHMALGVKKVLTSFLLFLSARNCGPERPRESSCHIVTISSSEFDG

SEQ ID NO: 122 - protein, 220 aa, Homo sapiens
MASAGMQILGVVLTLLGWVNGLVSCALPMWKVTAFIGNSIVVAQVVWEGLWMSCVVQSTGQMQCKVYDSLLALPQDLQAARALCVIALLVALFGLLVYLAGAKCTTCVEEKDSKARLVLTSGIVFVISGVLTLIPVCWTAHAIIRDFYNPLVAEAQKRELGASLYLGWAASGLLLLGGGLLCCTCPSGGSQGPSHYMARYSTSAPAISRGPSEYPTKNYV

SEQ ID NO: 123 - protein, 21 aa, Homo sapiens
MALPVTALLLPLALLLHAARP

SEQ ID NO: 124 - protein, 15 aa, Homo sapiens
GGGGSGGGGSGGGGS

SEQ ID NO: 125 - protein, 45 aa, Artificial Sequence
  Synthesized
TTTPAPRPPTPAPTIASQPLSLRPEACRPAAGGAVHTRGLDFACD

SEQ ID NO: 126 - protein, 23 aa, Artificial Sequence
  Synthesized
YIWAPLAGTCGVLLLSLVITLYC

SEQ ID NO: 127 - protein, 42 aa, Artificial Sequence; identical to SEQ ID NO: 3
  Synthesized

SEQ ID NO: 128 - protein, 112 aa, Artificial Sequence; identical to SEQ ID NO: 4
  Synthesized

SEQ ID NO: 129 - protein, 485 aa, Artificial Sequence
  Synthesized
MALPVTALLLPLALLLHAARPQIVLTQSPAIMSASLGERVTMTCTASSVVISTYLHWYQQKPGSSPKLWIYSTSNLASGVPVRFSGSGSGTSYSLTISSMEAEDAATYYCHQYHRSPWTFGGGTKLEIKGGGGSGGGGSGGGGSEVQLQQSGPELVKPGGSMKISCKASGYSFTGYTMNWVKQSHGKNLEWIGLINPYNGGISYNQKFKDKATLTMDKSSSTAYMELLSLTSEDSAIYFCARDYRYEGFDYWGQGTLVTVSATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 130 - protein, 241 aa, Artificial Sequence
  Synthesized
QIVLTQSPAIMSASLGERVTMTCTASSVVISTYLHWYQQKPGSSPKLWIYSTSNLASGVPVRFSGSGSGTSYSLTISSMEAEDAATYYCHQYHRSPWTFGGGTKLEIKGGGGSGGGGSGGGGSEVQLQQSGPELVKPGGSMKISCKASGYSFTGYTMNWVKQSHGKNLEWIGLINPYNGGISYNQKFKDKATLTMDKSSSTAYMELLSLTSEDSAIYFCARDYRYEGFDYWGQGTLVTVSA

SEQ ID NO: 131 - protein, 108 aa, Artificial Sequence
  Synthesized
QIVLTQSPAIMSASLGERVTMTCTASSVVISTYLHWYQQKPGSSPKLWIYSTSNLASGVPVRFSGSGSGTSYSLTISSMEAEDAATYYCHQYHRSPWTFGGGTKLEIK

SEQ ID NO: 132 - protein, 118 aa, Artificial Sequence
  Synthesized
EVQLQQSGPELVKPGGSMKISCKASGYSFTGYTMNWVKQSHGKNLEWIGLINPYNGGISYNQKFKDKATLTMDKSSSTAYMELLSLTSEDSAIYFCARDYRYEGFDYWGQGTLVTVSA

SEQ ID NO: 133 - protein, 488 aa, Artificial Sequence
  Synthesized
MALPVTALLLPLALLLHAARPENVLTQSPAIMSATLGEKVTMSCRATSNVKYMYWYQQKSGASPKLWIYYTSNLASGVPARFSGSGSGTSYSLTISSVEAADAATYYCQQFTSSPSTFGAGTKLELKGGGGSGGGGSGGGGSEVQLQQSGPELVKPGASVKISCKASGYSFTGYFMNWVKQSHGKSLEWIGRINPYNGDTFYNQKFKGKATLTVDKSSNTAHMELRSLTSEDSAVYYCARVLFLDFDDPYLMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 134 - protein, 244 aa, Artificial Sequence
  Synthesized
ENVLTQSPAIMSATLGEKVTMSCRATSNVKYMYWYQQKSGASPKLWIYYTSNLASGVPARFSGSGSGTSYSLTISSVEAADAATYYCQQFTSSPSTFGAGTKLELKGGGGSGGGGSGGGGSEVQLQQSGPELVKPGASVKISCKASGYSFTGYFMNWVKQSHGKSLEWIGRINPYNGDTFYNQKFKGKATLTVDKSSNTAHMELRSLTSEDSAVYYCARVLFLDFDDPYLMDYWGQGTSVTVSS

SEQ ID NO: 135 - protein, 106 aa, Artificial Sequence
  Synthesized
NVLTQSPAIMSATLGEKVTMSCRATSNVKYMYWYQQKSGASPKLWIYYTSNLASGVPARFSGSGSGTSYSLTISSVEAADAATYYCQQFTSSPSTFGAGTKLELKE

SEQ ID NO: 136 - protein, 123 aa, Artificial Sequence
  Synthesized
EVQLQQSGPELVKPGASVKISCKASGYSFTGYFMNWVKQSHGKSLEWIGRINPYNGDTFYNQKFKGKATLTVDKSSNTAHMELRSLTSEDSAVYYCARVLFLDFDDPYLMDYWGQGTSVTVSS

SEQ ID NO: 137 - protein, 485 aa, Artificial Sequence
  Synthesized
MALPVTALLLPLALLLHAARPDIQMTQSPASLSASVGETVTITCRASENIDSYLAWYQQKQGKSPQLLVYASTLLVDGVPSRFSGSRSGTQFSLKINSLQSEDVARYYCQHYYSIPYTFGSGTKLEIKGGGGSGGGGSGGGGSEVKLVESGGGLVKPGGSLKLSCAASGFTFNSYTMSWVRQTPAKRLEWVVTISSGGGRTYYPDSVKGRFTISRDNARNTLYLQMSSLRSEDTAMYYCIRGDYRYDGFAYWGQGTLVTVSTTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 138 - protein, 241 aa, Artificial Sequence
  Synthesized
DIQMTQSPASLSASVGETVTITCRASENIDSYLAWYQQKQGKSPQLLVYASTLLVDGVPSRFSGSRSGTQFSLKINSLQSEDVARYYCQHYYSIPYTFGSGTKLEIKGGGGSGGGGSGGGGSEVKLVESGGGLVKPGGSLKLSCAASGFTFNSYTMSWVRQTPAKRLEWVVTISSGGGRTYYPDSVKGRFTISRDNARNTLYLQMSSLRSEDTAMYYCIRGDYRYDGFAYWGQGTLVTVST

SEQ ID NO: 139 - protein, 107 aa, Artificial Sequence
  Synthesized
DIQMTQSPASLSASVGETVTITCRASENIDSYLAWYQQKQGKSPQLLVYASTLLVDGVPSRFSGSRSGTQFSLKINSLQSEDVARYYCQHYYSIPYTFGSGTKLEIK

SEQ ID NO: 140 - protein, 119 aa, Artificial Sequence
  Synthesized
EVKLVESGGGLVKPGGSLKLSCAASGFTFNSYTMSWVRQTPAKRLEWVVTISSGGGRTYYPDSVKGRFTISRDNARNTLYLQMSSLRSEDTAMYYCIRGDYRYDGFAYWGQGTLVTVST

SEQ ID NO: 141 - protein, 488 aa, Artificial Sequence
  Synthesized
MALPVTALLLPLALLLHAARPENVLTQSPAIMSATLGEKVTMSCRATSNVKYMYWYQQKSGASPKLWIYYTSNLASGVPARFSGSGSGTSYSLTISSVEAADAATYYCQQFTSSPSTFGAGTKLELKGGGGSGGGGSGGGGSEVQLQQSGPELVKPGASVKISCKASGYSFTGYFMNWVKQSHGKSLEWIGRINPYNGDTFYNQKFKGKATLTVDKSSSTAHMELRSLTSEDSAVYYCARVLFLDFDDPYLMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 142 - protein, 244 aa, Artificial Sequence
  Synthesized
ENVLTQSPAIMSATLGEKVTMSCRATSNVKYMYWYQQKSGASPKLWIYYTSNLASGVPARFSGSGSGTSYSLTISSVEAADAATYYCQQFTSSPSTFGAGTKLELKGGGGSGGGGSGGGGSEVQLQQSGPELVKPGASVKISCKASGYSFTGYFMNWVKQSHGKSLEWIGRINPYNGDTFYNQKFKGKATLTVDKSSSTAHMELRSLTSEDSAVYYCARVLFLDFDDPYLMDYWGQGTSVTVSS

SEQ ID NO: 143 - protein, 106 aa, Artificial Sequence
  Synthesized
ENVLTQSPAIMSATLGEKVTMSCRATSNVKYMYWYQQKSGASPKLWIYYTSNLASGVPARFSGSGSGTSYSLTISSVEAADAATYYCQQFTSSPSTFGAGTKLELK

SEQ ID NO: 144 - protein, 123 aa, Artificial Sequence
  Synthesized
EVQLQQSGPELVKPGASVKISCKASGYSFTGYFMNWVKQSHGKSLEWIGRINPYNGDTFYNQKFKGKATLTVDKSSSTAHMELRSLTSEDSAVYYCARVLFLDFDDPYLMDYWGQGTSVTVSS

SEQ ID NO: 145 - protein, 482 aa, Artificial Sequence
  Synthesized
MALPVTALLLPLALLLHAARPSSELTQDPAVSVALGQTVRITCRGDSLRKYYASWYQQKPRQAPQLVIYHKNNRASGIPDRFSGSISGNTASLTITGAQAEDEAAYFCNSRDTSGNYLVFGGGTKVTVLGGGGGSGGGGSGGGGSQLQLQESGPGLVKPSETLSLTCAVSGASISNWWSWVRQPPGKGLEWIGEVHHSGVTTYKPSLKSRVTISVDNSKNQLSLKLTSVTAADTAVYYCAREFADDAFDIWGRGTMVTVTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 146 - protein, 238 aa, Artificial Sequence
  Synthesized
SSELTQDPAVSVALGQTVRITCRGDSLRKYYASWYQQKPRQAPQLVIYHKNNRASGIPDRFSGSISGNTASLTITGAQAEDEAAYFCNSRDTSGNYLVFGGGTKVTVLGGGGGSGGGGSGGGGSQLQLQESGPGLVKPSETLSLTCAVSGASISNWWSWVRQPPGKGLEWIGEVHHSGVTTYKPSLKSRVTISVDNSKNQLSLKLTSVTAADTAVYYCAREFADDAFDIWGRGTMVTV

SEQ ID NO: 147 - protein, 109 aa, Artificial Sequence
  Synthesized
SSELTQDPAVSVALGQTVRITCRGDSLRKYYASWYQQKPRQAPQLVIYHKNNRASGIPDRFSGSISGNTASLTITGAQAEDEAAYFCNSRDTSGNYLVFGGGTKVTVLG

SEQ ID NO: 148 - protein, 114 aa, Artificial Sequence
  Synthesized
QLQLQESGPGLVKPSETLSLTCAVSGASISNWWSWVRQPPGKGLEWIGEVHHSGVTTYKPSLKSRVTISVDNSKNQLSLKLTSVTAADTAVYYCAREFADDAFDIWGRGTMVTV

SEQ ID NO: 149 - protein, 250 aa, Artificial Sequence
  Synthesized
DIVMTQSPLSLPVTPGEPASISCRSTKSLLHSNGNTYLYWYLQKPGQSPQLLIYRMSNLASGVPDRFSGSGSGTDFTLKISRVEAEDVGVYYCMQHLEYPFTFGGGTKVEIKGGGGSGGGGSGGGGSEIQLQQSGAEVKKPGSSVKVSCKASGYTFTDYDMHWVRQAPGQGLEWMGTIDPETGGTAYNQKFKGRVTITADKSTSTAYMELSSLRSEDTAVYYCTSFYYTYSNYDVGFAYWGQGTLVTVSS

SEQ ID NO: 150 - protein, 250 aa, Artificial Sequence
  Synthesized
DIVMTQSPLSLPVTPGEPASISCRSTKSLLHSNGNTYLYWYLQKPGQSPQLLIYRMSNLASGVPDRFSGSGSGTDFTLKISRVEAEDVGVYYCMQHLEYPFTFGGGTKVEIKGGGGSGGGGSGGGGSEIQLQQSGAEVKKPGSSVKVSCKASGYTFTDYDMHWVRQAPGQGLEWIGTIDPETGGTAYNQKFKGRATLTADRSTSTAYMELSSLRSEDTAVYYCTSFYYTYSNYDVGFAYWGQGTLVTVSS

SEQ ID NO: 151 - protein, 250 aa, Artificial Sequence
  Synthesized
DIVMTQSPLSLPVTPGEPASISCRSTKSLLHSNGNTYLYWYLQKPGQSPQLLIYRMSNLASGVPDRFSGSGSGTDFTLKISRVEAEDVGVYYCMQHLEYPFTFGGGTKVEIKGGGGSGGGGSGGGGSEIQLQQSGAEVKKPGSSVKVSCKASGYTFTDYDMHWVKQAPGQGLEWIGTIDPETGGTAYNQKFKGKATLTADRSTSTAYMELSSLRSEDTAVYYCTSFYYTYSNYDVGFAYWGQGTLVTVSS

SEQ ID NO: 152 - protein, 250 aa, Artificial Sequence
  Synthesized
DIVMTQSPLSLPVTPGEPASISCRSTKSLLHSNGNTYLYWYLQKPGQSPQLLIYRMSNLASGVPDRFSGSGSGTDFTLKISRVEAEDVGVYYCMQHLEYPFTFGGGTKVEIKGGGGSGGGGSGGGGSEIQLQQSGAEVKKPGSSVKVSCKASGYTFTDYDMHWVKQAPGHGLEWIGTIDPETGGTAYNQKFKGKATLTADRSTSTAYMELSSLTSEDTAVYYCTSFYYTYSNYDVGFAYWGQGTLVTVSS

SEQ ID NO: 153 - protein, 250 aa, Artificial Sequence
  Synthesized
DIVMTQSPLSLPVTPGEPASISCRSTKSLLHSNGNTYLYWFLQKPGQSPQLLIYRMSNLASGVPDRFSGSGSGTDFTLKISRVEAEDVGVYYCMQHLEYPFTFGGGTKVEIKGGGGSGGGGSGGGGSEIQLQQSGAEVKKPGSSVKVSCKASGYTFTDYDMHWVRQAPGQGLEWMGTIDPETGGTAYNQKFKGRVTITADKSTSTAYMELSSLRSEDTAVYYCTSFYYTYSNYDVGFAYWGQGTLVTVSS

SEQ ID NO: 154 - protein, 250 aa, Artificial Sequence
  Synthesized
DIVMTQSPLSLPVTPGEPASISCRSTKSLLHSNGNTYLYWFLQKPGQSPQLLIYRMSNLASGVPDRFSGSGSGTDFTLKISRVEAEDVGVYYCMQHLEYPFTFGGGTKVEIKGGGGSGGGGSGGGGSEIQLQQSGAEVKKPGSSVKVSCKASGYTFTDYDMHWVRQAPGQGLEWIGTIDPETGGTAYNQKFKGRATLTADRSTSTAYMELSSLRSEDTAVYYCTSFYYTYSNYDVGFAYWGQGTLVTVSS

SEQ ID NO: 155 - protein, 250 aa, Artificial Sequence
  Synthesized
DIVMTQSPLSLPVTPGEPASISCRSTKSLLHSNGNTYLYWFLQKPGQSPQLLIYRMSNLASGVPDRFSGSGSGTDFTLKISRVEAEDVGVYYCMQHLEYPFTFGGGTKVEIKGGGGSGGGGSGGGGSEIQLQQSGAEVKKPGSSVKVSCKASGYTFTDYDMHWVKQAPGQGLEWIGTIDPETGGTAYNQKFKGKATLTADRSTSTAYMELSSLRSEDTAVYYCTSFYYTYSNYDVGFAYWGQGTLVTVSS

SEQ ID NO: 156 - protein, 250 aa, Artificial Sequence
  Synthesized
DIVMTQSPLSLPVTPGEPASISCRSTKSLLHSNGNTYLYWFLQKPGQSPQLLIYRMSNLASGVPDRFSGSGSGTDFTLKISRVEAEDVGVYYCMQHLEYPFTFGGGTKVEIKGGGGSGGGGSGGGGSEIQLQQSGAEVKKPGSSVKVSCKASGYTFTDYDMHWVKQAPGHGLEWIGTIDPETGGTAYNQKFKGKATLTADRSTSTAYMELSSLTSEDTAVYYCTSFYYTYSNYDVGFAYWGQGTLVTVSS

SEQ ID NO: 157 - protein, 112 aa, Artificial Sequence
  Synthesized
DIVMTQSPLSLPVTPGEPASISCRSTKSLLHSNGNTYLYWYLQKPGQSPQLLIYRMSNLASGVPDRFSGSGSGTDFTLKISRVEAEDVGVYYCMQHLEYPFTFGGGTKVEIK

SEQ ID NO: 158 - protein, 112 aa, Artificial Sequence
  Synthesized
DIVMTQSPLSLPVTPGEPASISCRSTKSLLHSNGNTYLYWFLQKPGQSPQLLIYRMSNLASGVPDRFSGSGSGTDFTLKISRVEAEDVGVYYCMQHLEYPFTFGGGTKVEIK

SEQ ID NO: 159 - protein, 123 aa, Artificial Sequence
  Synthesized
EIQLQQSGAEVKKPGSSVKVSCKASGYTFTDYDMHWVRQAPGQGLEWMGTIDPETGGTAYNQKFKGRVTITADKSTSTAYMELSSLRSEDTAVYYCTSFYYTYSNYDVGFAYWGQGTLVTVSS

SEQ ID NO: 160 - protein, 123 aa, Artificial Sequence
  Synthesized
EIQLQQSGAEVKKPGSSVKVSCKASGYTFTDYDMHWVRQAPGQGLEWIGTIDPETGGTAYNQKFKGRATLTADRSTSTAYMELSSLRSEDTAVYYCTSFYYTYSNYDVGFAYWGQGTLVTVSS

SEQ ID NO: 161 - protein, 123 aa, Artificial Sequence
  Synthesized
EIQLQQSGAEVKKPGSSVKVSCKASGYTFTDYDMHWVKQAPGQGLEWIGTIDPETGGTAYNQKFKGKATLTADRSTSTAYMELSSLRSEDTAVYYCTSFYYTYSNYDVGFAYWGQGTLVTVSS

SEQ ID NO: 162 - protein, 123 aa, Artificial Sequence
  Synthesized
EIQLQQSGAEVKKPGSSVKVSCKASGYTFTDYDMHWVKQAPGHGLEWIGTIDPETGGTAYNQKFKGKATLTADRSTSTAYMELSSLTSEDTAVYYCTSFYYTYSNYDVGFAYWGQGTLVTVSS

SEQ ID NO: 163 - protein, 482 aa, Artificial Sequence
  Synthesized
MALPVTALLLPLALLLHAARPDIQMTQSPSSLSASVGDRVTITCKASDLIHNWLAWYQQKPGKAPKLLIYGATSLETGVPSRFSGSGSGTDFTLTISSLQPEDFATYYCQQYWTTPFTFGQGTKVEIKGGGGSGGGGSGGGGSEVQLVESGGGLVQPGGSLRLSCAASGYSITNDYAWNWVRQAPGKGLEWVGYISYSGYTTYNPSLKSRFTISRDTSKNTLYLQMNSLRAEDTAVYYCARWTSGLDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 164 - protein, 238 aa, Artificial Sequence
  Synthesized
DIQMTQSPSSLSASVGDRVTITCKASDLIHNWLAWYQQKPGKAPKLLIYGATSLETGVPSRFSGSGSGTDFTLTISSLQPEDFATYYCQQYWTTPFTFGQGTKVEIKGGGGSGGGGSGGGGSEVQLVESGGGLVQPGGSLRLSCAASGYSITNDYAWNWVRQAPGKGLEWVGYISYSGYTTYNPSLKSRFTISRDTSKNTLYLQMNSLRAEDTAVYYCARWTSGLDYWGQGTLVTVSS

SEQ ID NO: 165 - protein, 107 aa, Artificial Sequence
  Synthesized
DIQMTQSPSSLSASVGDRVTITCKASDLIHNWLAWYQQKPGKAPKLLIYGATSLETGVPSRFSGSGSGTDFTLTISSLQPEDFATYYCQQYWTTPFTFGQGTKVEIK

SEQ ID NO: 166 - protein, 116 aa, Artificial Sequence
  Synthesized
EVQLVESGGGLVQPGGSLRLSCAASGYSITNDYAWNWVRQAPGKGLEWVGYISYSGYTTYNPSLKSRFTISRDTSKNTLYLQMNSLRAEDTAVYYCARWTSGLDYWGQGTLVTVSS

SEQ ID NO: 167 - protein, 482 aa, Artificial Sequence
  Synthesized
MALPVTALLLPLALLLHAARPDIQMTQSSSFLSVSLGGRVTITCKASDLIHNWLAWYQQKPGNAPRLLISGATSLETGVPSRFSGSGSGNDYTLSIASLQTEDAATYYCQQYWTTPFTFGSGTKVEIKGGGGSGGGGSGGGGSDVQLQESGPGLVNPSQSLSLTCTVTGYSITNDYAWNWIRQFPGNKLEWMGYINYSGYTTYNPSLKSRISITRDTSKNQFFLHLNSVTTEDTATYYCARWDGGLTYWGQGTLVTVSATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 168 - protein, 238 aa, Artificial Sequence
  Synthesized
DIQMTQSSSFLSVSLGGRVTITCKASDLIHNWLAWYQQKPGNAPRLLISGATSLETGVPSRFSGSGSGNDYTLSIASLQTEDAATYYCQQYWTTPFTFGSGTKVEIKGGGGSGGGGSGGGGSDVQLQESGPGLVNPSQSLSLTCTVTGYSITNDYAWNWIRQFPGNKLEWMGYINYSGYTTYNPSLKSRISITRDTSKNQFFLHLNSVTTEDTATYYCARWDGGLTYWGQGTLVTVSA

SEQ ID NO: 169 - protein, 107 aa, Artificial Sequence
  Synthesized
DIQMTQSSSFLSVSLGGRVTITCKASDLIHNWLAWYQQKPGNAPRLLISGATSLETGVPSRFSGSGSGNDYTLSIASLQTEDAATYYCQQYWTTPFTFGSGTKVEIK

SEQ ID NO: 170 - protein, 116 aa, Artificial Sequence
  Synthesized
DVQLQESGPGLVNPSQSLSLTCTVTGYSITNDYAWNWIRQFPGNKLEWMGYINYSGYTTYNPSLKSRISITRDTSKNQFFLHLNSVTTEDTATYYCARWDGGLTYWGQGTLVTVSA

SEQ ID NO: 171 - protein, 298 aa, Artificial Sequence
  Synthesized
MALPVTALLLPLALLLHAARPGTSLSPPPESSGSPQQPGLSAPHSRQIPAPQGAVLVQREKDLPNYNWNSFGLRFTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 172 - protein, 54 aa, Artificial Sequence
  Synthesized
GTSLSPPPESSGSPQQPGLSAPHSRQIPAPQGAVLVQREKDLPNYNWNSFGLRF

SEQ ID NO: 173 - protein, 19 aa, Artificial Sequence
  Synthesized
GTTGCTCCAGGCCACAGCA

SEQ ID NO: 174 - protein, 7 aa, Artificial Sequence
  Synthesized
QSGDLTR

SEQ ID NO: 175 - protein, 7 aa, Artificial Sequence
  Synthesized
QWGTRYR

SEQ ID NO: 176 - protein, 7 aa, Artificial Sequence
  Synthesized
ERGTLAR

SEQ ID NO: 177 - protein, 7 aa, Artificial Sequence
  Synthesized
RSDNLRE

SEQ ID NO: 178 - protein, 7 aa, Artificial Sequence
  Synthesized
QSGDLTR

SEQ ID NO: 179 - protein, 7 aa, Artificial Sequence
  Synthesized
TSGALTR

SEQ ID NO: 180 - protein, 12 aa, Artificial Sequence
  Synthesized
GACTTTGCATGT

SEQ ID NO: 181 - protein, 7 aa, Artificial Sequence
  Synthesized
WRSSLAS

SEQ ID NO: 182 - protein, 7 aa, Artificial Sequence
  Synthesized
QSGSLTR

SEQ ID NO: 183 - protein, 7 aa, Artificial Sequence
  Synthesized
HKWVLRQ

SEQ ID NO: 184 - protein, 7 aa, Artificial Sequence
  Synthesized
DRSNLTR

SEQ ID NO: 185 - protein, 293 aa, Artificial Sequence
  Synthesized
MQRISSLIHLSLFWAGVMSAIELVPEHQTVPVSIGVPATLRCSMKGEAIGNYYINWYRKTQGNTITFIYREKDIYGPGFKDNFQGDIDIAKNLAVLKILAPSERDEGSYYCACDTMGHPRGKLIFGKGTRVTVEPRSQPHTKPSVFVMKNGTNVACLVKEFYPKDIRINLVSSKKITEFDPAIVISPSGKYNAVKLGKYEDSNSVTCSVQHDNKTVHSTDFEVKTDSTDHVKPKETENTKQPSKSCHKPKAIVHTEKVNMMSLTVLGLRMLFAKTVAVNFLLTAKLFFLTRDC

SEQ ID NO: 186 - protein, 315 aa, Artificial Sequence
  Synthesized
MVSLLHASTLAVLGALCVYGAGHLEQPQISSTKTLSKTARLECVVSGITISATSVYWYRERPGEVIQFLVSISYDGTVRKESGIPSGKFEVDRIPETSTSTLTIHNVEKQDIATYYCALWEAQQELGKKIKVFGPGTKLIITDKQLDADVSPKPTIFLPSIAETKLQKAGTYLCLLEKFFPDVIKIHWEEKKSNTILGSQEGNTMKTNDTYMKFSWLTVPEKSLDKEHRCIVRHENNKNGVDQEIIFPPIKTDVITMDPKDNCSKDANDTLLLQLTNTSAYYMYLLLLLKSVVYFAIITCCLLRRTAFCCNGEKS

SEQ ID NO: 187 - protein, 292 aa, Artificial Sequence
  Synthesized
MERISSLIHLSLFWAGVMSAIELVPEHQTVPVSIGVPATLRCSMKGEAIGNYYINWYRKTQGNTMTFIYREKDIYGPGFKDNFQGDIDIAKNLAVLKILAPSERDEGSYYCACDTLGMGGEYTDKLIFGKGTRVTVEPRSQPHTKPSVFVMKNGTNVACLVKEFYPKDIRINLVSSKKITEFDPAIVISPSGKYNAVKLGKYEDSNSVTCSVQHDNKTVHSTDFEVKTDSTDHVKPKETENTKQPSKSCHKPKAIVHTEKVNMMSLTVLGLRMLFAKTVAVNFLLTAKLFFL

SEQ ID NO: 188 - protein, 313 aa, Artificial Sequence
  Synthesized
MVSLLHASTLAVLGALCVYGAGHLEQPQISSTKTLSKTARLECVVSGITISATSVYWYRERPGEVIQFLVSISYDGTVRKESGIPSGKFEVDRIPETSTSTLTIHNVEKQDIATYYCALWEWELGKKIKVFGPGTKLIITDKQLDADVSPKPTIFLPSIAETKLQKAGTYLCLLEKFFPDVIKIHWEEKKSNTILGSQEGNTMKTNDTYMKFSWLTVPEKSLDKEHRCIVRHENNKNGVDQEIIFPPIKTDVITMDPKDNCSKDANDTLLLQLTNTSAYYMYLLLLLKSVVYFAIITCCLLRRTAFCCNGEKS

SEQ ID NO: 189 - protein, 288 aa, Artificial Sequence
  Synthesized
MERISSLIHLSLFWAGVMSAIELVPEHQTVPVSIGVPATLRCSMKGEAIGNYYINWYRKTQGNTMTFIYREKDIYGPGFKDNFQGDIDIAKNLAVLKILAPSERDEGSYYCACDTLVSTDKLIFGKGTRVTVEPRSQPHTKPSVFVMKNGTNVACLVKEFYPKDIRINLVSSKKITEFDPAIVISPSGKYNAVKLGKYEDSNSVTCSVQHDNKTVHSTDFEVKTDSTDHVKPKETENTKQPSKSCHKPKAIVHTEKVNMMSLTVLGLRMLFAKTVAVNFLLTAKLFFL

SEQ ID NO: 190 - protein, 314 aa, Artificial Sequence
  Synthesized
MVSLLHASTLAVLGALCVYGAGHLEQPQISSTKTLSKTARLECVVSGITISATSVYWYRERPGEVIQFLVSISYDGTVRKESGIPSGKFEVDRIPETSTSTLTIHNVEKQDIATYYCALWEVGELGKKIKVFGPGTKLIITDKQLDADVSPKPTIFLPSIAETKLQKAGTYLCLLEKFFPDVIKIHWEEKKSNTILGSQEGNTMKTNDTYMKFSWLTVPEKSLDKEHRCIVRHENNKNGVDQEIIFPPIKTDVITMDPKDNCSKDANDTLLLQLTNTSAYYMYLLLLLKSVVYFAIITCCLLRRTAFCCNGEKS

SEQ ID NO: 191 - protein, 291 aa, Artificial Sequence
  Synthesized
MERISSLIHLSLFWAGVMSAIELVPEHQTVPVSIGVPATLRCSMKGEAIGNYYINWYRKTQGNTMTFIYREKDIYGPGFKDNFQGDIDIAKNLAVLKILAPSERDEGSYYCACDTVAHGGGTDKLIFGKGTRVTVEPRSQPHTKPSVFVMKNGTNVACLVKEFYPKDIRINLVSSKKITEFDPAIVISPSGKYNAVKLGKYEDSNSVTCSVQHDNKTVHSTDFEVKTDSTDHVKPKETENTKQPSKSCHKPKAIVHTEKVNMMSLTVLGLRMLFAKTVAVNFLLTAKLFFL

SEQ ID NO: 192 - protein, 313 aa, Artificial Sequence; identical to SEQ ID NO: 188
  Synthesized

SEQ ID NO: 193 - protein, 291 aa, Artificial Sequence
  Synthesized
MERISSLIHLSLFWAGVMSAIELVPEHQTVPVSIGVPATLRCSMKGEAIGNYYINWYRKTQGNTMTFIYREKDIYGPGFKDNFQGDIDIAKNLAVLKILAPSERDEGSYYCACDNLSTGGYTDKLIFGKGTRVTVEPRSQPHTKPSVFVMKNGTNVACLVKEFYPKDIRINLVSSKKITEFDPAIVISPSGKYNAVKLGKYEDSNSVTCSVQHDNKTVHSTDFEVKTDSTDHVKPKETENTKQPSKSCHKPKAIVHTEKVNMMSLTVLGLRMLFAKTVAVNFLLTAKLFFL

SEQ ID NO: 194 - protein, 316 aa, Artificial Sequence
  Synthesized
MVSLLHASTLAVLGALCVYGAGHLEQPQISSTKTLSKTARLECVVSGITISATSVYWYRERPGEVIQFLVSISYDGTVRKESGIPSGKFEVDRIPETSTSTLTIHNVEKQDIATYYCALWEVYQGELGKKIKVFGPGTKLIITDKQLDADVSPKPTIFLPSIAETKLQKAGTYLCLLEKFFPDVIKIHWEEKKSNTILGSQEGNTMKTNDTYMKFSWLTVPEKSLDKEHRCIVRHENNKNGVDQEIIFPPIKTDVITMDPKDNCSKDANDTLLLQLTNTSAYYMYLLLLLKSVVYFAIITCCLLRRTAFCCNGEKS

SEQ ID NO: 195 - protein, 291 aa, Artificial Sequence
  Synthesized
MERISSLIHLSLFWAGVMSAIELVPEHQTVPVSIGVPATLRCSMKGEAIGNYYINWYRKTQGNTMTFIYREKDIYGPGFKDNFQGDIDIAKNLAVLKILAPSERDEGSYYCACDILGEKPYTDKLIFGKGTRVTVEPRSQPHTKPSVFVMKNGTNVACLVKEFYPKDIRINLVSSKKITEFDPAIVISPSGKYNAVKLGKYEDSNSVTCSVQHDNKTVHSTDFEVKTDSTDHVKPKETENTKQPSKSCHKPKAIVHTEKVNMMSLTVLGLRMLFAKTVAVNFLLTAKLFFL

SEQ ID NO: 196 - DNA, 339 bp, Artificial Sequence; identical to SEQ ID NO: 41
  Synthesized

SEQ ID NO: 197 - protein, 276 aa, Artificial Sequence
  Synthesized
MKKHLTTFLVILWLYFYRGNGKNQVEQSPQSLIILEGKNCTLQCNYTVSPFSNLRWYKQDTGRGPVSLTIMTFSENTKSNGRYTATLDADTKQSSLHITASQLSDSASYICVVSDRGSTLGRLYFGRGTQLTVWPDIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 198 - protein, 313 aa, Artificial Sequence
  Synthesized
MTIRLLCYVGFYFLGAGLMEADIYQTPRYLVIGTGKKITLECSQTMGHDKMYWYQQDPGMELHLIHYSYGVNSTEKGDLSSESTVSRIRTEHFPLTLESARPSHTSQYLCASSGLRDRGLYEQYFGPGTRLTVTEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 199 - protein, 267 aa, Artificial Sequence
  Synthesized
MWGVFLLYVSMKMGGTTGQNIDQPTEMTATEGAIVQINCTYQTSGFNGLFWYQQHAGEAPTFLSYNVLDGLEEKGRFSSFLSRSKGYSYLLLKELQMKDSASYLCAVKDSNYQLIWGAGTKLIIKPNIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 200 - protein, 138 aa, Artificial Sequence
  Synthesized
MAVLVLLLCLLIFPSCVLSQVQLKESGPGLVQPSQTLSLTCTVSGSSLTSNSVSWIRQPPGKGLEWMGVIWSNGDADYNSAIKSRLSISRDTSKSQVFLKMNSLQTEDTAMYFCASPYYGYYFPFDYWGQGVMVTVSS

SEQ ID NO: 201 - DNA, 3533 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 202 - protein, 488 aa, Artificial Sequence
  Synthesized
MALPVTALLLPLALLLHAARPDIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 203 - protein, 486 aa, Artificial Sequence
  Synthesized
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 204 - DNA, 3524 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 205 - protein, 485 aa, Artificial Sequence
  Synthesized
MALPVTALLLPLALLLHAARPDIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 206 - DNA, 3524 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 207 - protein, 483 aa, Artificial Sequence
  Synthesized
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 208 - DNA, 3515 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 209 - DNA, 3533 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 210 - protein, 490 aa, Artificial Sequence
  Synthesized
MALPVTALLLPLALLLHAARPDIVMTQAAFSNPVTLGTSASISCRSSKSLLHSNGITYFFWYLQKPGLSPQLLIYQMSNLASGVPDRFSSSGSGTDFTLRISRVEAEDVGVYYCAQNLELPPTFGGGTKLEIKRAGGGGSGGGGSGGGGSEVKLVESGGGLVQPGGSMKLSCVASGFTFSNYWMNWVRQSPEKGLEWVAEIRLKSNNYTTHYAESVKGRFTISRDDSKSSVSLQMNNLRVEDTGIYYCTRHYYFDYWGQGTTLTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 211 - DNA, 3524 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 212 - protein, 487 aa, Artificial Sequence
  Synthesized
MALPVTALLLPLALLLHAARPDIVMTQAAFSNPVTLGTSASISCRSSKSLLHSNGITYFFWYLQKPGLSPQLLIYQMSNLASGVPDRFSSSGSGTDFTLRISRVEAEDVGVYYCAQNLELPPTFGGGTKLEIKRAGGGGSGGGGSGGGGSEVKLVESGGGLVQPGGSMKLSCVASGFTFSNYWMNWVRQSPEKGLEWVAEIRLKSNNYTTHYAESVKGRFTISRDDSKSSVSLQMNNLRVEDTGIYYCTRHYYFDYWGQGTTLTVSSTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 213 - DNA, 3524 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 214 - DNA, 3515 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 215 - DNA, 3533 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggatatccagatgacccagagcccgagcagcctgagcgcgagcgtgggtgatcgcgtgaccattacctgcagggcaagtcaggacattagtaaatatttaaattggtatcagcagaaaccgggtaaagcgccgaaactgttaatttatcatacatcaagattacactcaggcgtgccgtcgcgttttagcggctcgggttcgggcaccgattttaccctgaccatctcgagcttgcagccggaggacttcgccacctactattgccaacagggtaatacgcttccgtacacgttcggtcagggcaccaaagtggagatcaaaggtggcggtggctcgggcggtggtgggtcgggtggcggcggatctgaggtgcagctggtggagtctgggggaggcttggtacagcctggggggtccctgagactctcctgtgcagcctctggagtgtccctgcctgattatggcgtgtcctgggtccgccaggctccagggaaggggctggagtgggtttcagtgatctggggcagcgagacaacctactacaacagcgccctgaagtcccgattcaccatctccagagacaatgccaagaactcactgtatctgcaaatgaacagcctgagagccgaggacacggctgtgtattactgtgcgaagcactactactacggcggcagctacgctatggactactggggccaaggaaccctggtcaccgtgtcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 216 - protein, 486 aa, Artificial Sequence
  Synthesized
MALPVTALLLPLALLLHAARPDIQMTQSPSSLSASVGDRVTITCRASQDISKYLNWYQQKPGKAPKLLIYHTSRLHSGVPSRFSGSGSGTDFTLTISSLQPEDFATYYCQQGNTLPYTFGQGTKVEIKGGGGSGGGGSGGGGSEVQLVESGGGLVQPGGSLRLSCAASGVSLPDYGVSWVRQAPGKGLEWVSVIWGSETTYYNSALKSRFTISRDNAKNSLYLQMNSLRAEDTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 217 - DNA, 3524 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggatatccagatgacccagagcccgagcagcctgagcgcgagcgtgggtgatcgcgtgaccattacctgcagggcaagtcaggacattagtaaatatttaaattggtatcagcagaaaccgggtaaagcgccgaaactgttaatttatcatacatcaagattacactcaggcgtgccgtcgcgttttagcggctcgggttcgggcaccgattttaccctgaccatctcgagcttgcagccggaggacttcgccacctactattgccaacagggtaatacgcttccgtacacgttcggtcagggcaccaaagtggagatcaaaggtggcggtggctcgggcggtggtgggtcgggtggcggcggatctgaggtgcagctggtggagtctgggggaggcttggtacagcctggggggtccctgagactctcctgtgcagcctctggagtgtccctgcctgattatggcgtgtcctgggtccgccaggctccagggaaggggctggagtgggtttcagtgatctggggcagcgagacaacctactacaacagcgccctgaagtcccgattcaccatctccagagacaatgccaagaactcactgtatctgcaaatgaacagcctgagagccgaggacacggctgtgtattactgtgcgaagcactactactacggcggcagctacgctatggactactggggccaaggaaccctggtcaccgtgtcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 218 - DNA, 3524 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggatatccagatgacccagagcccgagcagcctgagcgcgagcgtgggtgatcgcgtgaccattacctgcagggcaagtcaggacattagtaaatatttaaattggtatcagcagaaaccgggtaaagcgccgaaactgttaatttatcatacatcaagattacactcaggcgtgccgtcgcgttttagcggctcgggttcgggcaccgattttaccctgaccatctcgagcttgcagccggaggacttcgccacctactattgccaacagggtaatacgcttccgtacacgttcggtcagggcaccaaagtggagatcaaaggtggcggtggctcgggcggtggtgggtcgggtggcggcggatctgaggtgcagctggtggagtctgggggaggcttggtacagcctggggggtccctgagactctcctgtgcagcctctggagtgtccctgcctgattatggcgtgtcctgggtccgccaggctccagggaaggggctggagtgggtttcagtgatctggggcagcgagacaacctactacaacagcgccctgaagtcccgattcaccatctccagagacaatgccaagaactcactgtatctgcaaatgaacagcctgagagccgaggacacggctgtgtattactgtgcgaagcactactactacggcggcagctacgctatggactactggggccaaggaaccctggtcaccgtgtcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 219 - protein, 483 aa, Artificial Sequence
  Synthesized
MALPVTALLLPLALLLHAARPDIQMTQSPSSLSASVGDRVTITCRASQDISKYLNWYQQKPGKAPKLLIYHTSRLHSGVPSRFSGSGSGTDFTLTISSLQPEDFATYYCQQGNTLPYTFGQGTKVEIKGGGGSGGGGSGGGGSEVQLVESGGGLVQPGGSLRLSCAASGVSLPDYGVSWVRQAPGKGLEWVSVIWGSETTYYNSALKSRFTISRDNAKNSLYLQMNSLRAEDTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 220 - DNA, 3515 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggatatccagatgacccagagcccgagcagcctgagcgcgagcgtgggtgatcgcgtgaccattacctgcagggcaagtcaggacattagtaaatatttaaattggtatcagcagaaaccgggtaaagcgccgaaactgttaatttatcatacatcaagattacactcaggcgtgccgtcgcgttttagcggctcgggttcgggcaccgattttaccctgaccatctcgagcttgcagccggaggacttcgccacctactattgccaacagggtaatacgcttccgtacacgttcggtcagggcaccaaagtggagatcaaaggtggcggtggctcgggcggtggtgggtcgggtggcggcggatctgaggtgcagctggtggagtctgggggaggcttggtacagcctggggggtccctgagactctcctgtgcagcctctggagtgtccctgcctgattatggcgtgtcctgggtccgccaggctccagggaaggggctggagtgggtttcagtgatctggggcagcgagacaacctactacaacagcgccctgaagtcccgattcaccatctccagagacaatgccaagaactcactgtatctgcaaatgaacagcctgagagccgaggacacggctgtgtattactgtgcgaagcactactactacggcggcagctacgctatggactactggggccaaggaaccctggtcaccgtgtcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 221 - DNA, 3533 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggatatccagatgacccagagcccgagcagcctgagcgcgagcgtgggtgatcgcgtgaccattacctgcagggcaagtcaggacattagtaaatatttaaattggtatcagcagaaaccgggtaaagcgccgaaactgttaatttatcatacatcaagattacactcaggcgtgccgtcgcgttttagcggctcgggttcgggcaccgattttaccctgaccatctcgagcttgcagccggaggacttcgccacctactattgccaacagggtaatacgcttccgtacacgttcggtcagggcaccaaagtggagatcaaaggtggcggtggctcgggcggtggtgggtcgggtggcggcggatctgaggtgcagctggtggagtctgggggaggcttggtacagcctggggggtccctgagactctcctgtgcagcctctggagtgtccctgcctgattatggcgtgtcctgggtccgccaggctccagggaaggggctggagtgggtttcagtgatctggggcagcgagacaacctactacaacagcgccctgaagtcccgattcaccatctccagagacaatgccaagaactcactgtatctgcaaatgaacagcctgagagccgaggacacggctgtgtattactgtgcgaagcactactactacggcggcagctacgctatggactactggggccaaggaaccctggtcaccgtgtcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 222 - DNA, 3524 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggatatccagatgacccagagcccgagcagcctgagcgcgagcgtgggtgatcgcgtgaccattacctgcagggcaagtcaggacattagtaaatatttaaattggtatcagcagaaaccgggtaaagcgccgaaactgttaatttatcatacatcaagattacactcaggcgtgccgtcgcgttttagcggctcgggttcgggcaccgattttaccctgaccatctcgagcttgcagccggaggacttcgccacctactattgccaacagggtaatacgcttccgtacacgttcggtcagggcaccaaagtggagatcaaaggtggcggtggctcgggcggtggtgggtcgggtggcggcggatctgaggtgcagctggtggagtctgggggaggcttggtacagcctggggggtccctgagactctcctgtgcagcctctggagtgtccctgcctgattatggcgtgtcctgggtccgccaggctccagggaaggggctggagtgggtttcagtgatctggggcagcgagacaacctactacaacagcgccctgaagtcccgattcaccatctccagagacaatgccaagaactcactgtatctgcaaatgaacagcctgagagccgaggacacggctgtgtattactgtgcgaagcactactactacggcggcagctacgctatggactactggggccaaggaaccctggtcaccgtgtcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 223 - DNA, 3524 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggatatccagatgacccagagcccgagcagcctgagcgcgagcgtgggtgatcgcgtgaccattacctgcagggcaagtcaggacattagtaaatatttaaattggtatcagcagaaaccgggtaaagcgccgaaactgttaatttatcatacatcaagattacactcaggcgtgccgtcgcgttttagcggctcgggttcgggcaccgattttaccctgaccatctcgagcttgcagccggaggacttcgccacctactattgccaacagggtaatacgcttccgtacacgttcggtcagggcaccaaagtggagatcaaaggtggcggtggctcgggcggtggtgggtcgggtggcggcggatctgaggtgcagctggtggagtctgggggaggcttggtacagcctggggggtccctgagactctcctgtgcagcctctggagtgtccctgcctgattatggcgtgtcctgggtccgccaggctccagggaaggggctggagtgggtttcagtgatctggggcagcgagacaacctactacaacagcgccctgaagtcccgattcaccatctccagagacaatgccaagaactcactgtatctgcaaatgaacagcctgagagccgaggacacggctgtgtattactgtgcgaagcactactactacggcggcagctacgctatggactactggggccaaggaaccctggtcaccgtgtcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 224 - DNA, 3515 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggatatccagatgacccagagcccgagcagcctgagcgcgagcgtgggtgatcgcgtgaccattacctgcagggcaagtcaggacattagtaaatatttaaattggtatcagcagaaaccgggtaaagcgccgaaactgttaatttatcatacatcaagattacactcaggcgtgccgtcgcgttttagcggctcgggttcgggcaccgattttaccctgaccatctcgagcttgcagccggaggacttcgccacctactattgccaacagggtaatacgcttccgtacacgttcggtcagggcaccaaagtggagatcaaaggtggcggtggctcgggcggtggtgggtcgggtggcggcggatctgaggtgcagctggtggagtctgggggaggcttggtacagcctggggggtccctgagactctcctgtgcagcctctggagtgtccctgcctgattatggcgtgtcctgggtccgccaggctccagggaaggggctggagtgggtttcagtgatctggggcagcgagacaacctactacaacagcgccctgaagtcccgattcaccatctccagagacaatgccaagaactcactgtatctgcaaatgaacagcctgagagccgaggacacggctgtgtattactgtgcgaagcactactactacggcggcagctacgctatggactactggggccaaggaaccctggtcaccgtgtcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 225 - DNA, 3545 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggatatccagatgacccagagcccaagctccctgtccgcctctgtgggcgacagggtgaccatcacatgccgcgccagccagacaatctggtcctacctgaactggtatcagcagagacccggcaaggcccctaatctgctgatctacgcagcatctagcctgcagtctggagtgccctcccggttctctggaagaggatccggaaccgacttcaccctgacaatctcctctctgcaggccgaggacttcgccacatactattgccagcagagctattccatccctcagacctttggccagggcacaaagctggagatcaagggcggcggcggctctggaggaggaggaagcggaggaggaggatcccaggtgcagctgcagcagagcggaccaggactggtgaagccctcccagaccctgtctctgacatgtgccatcagcggcgattccgtgagctccaacagcgccgcctggaattggatccggcagtctcccagcagaggactggagtggctgggaaggacctactatcgctccaagtggtacaacgattatgccgtgtctgtgaagagccggatcaccatcaaccctgacacatctaagaatcagttcagcctgcagctgaattccgtgaccccagaggacacagccgtgtactattgtgcaagggaggtgaccggcgacctggaggatgcctttgacatctggggccagggcaccatggtgacagtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 226 - protein, 490 aa, Artificial Sequence
  Synthesized
MALPVTALLLPLALLLHAARPDIQMTQSPSSLSASVGDRVTITCRASQTIWSYLNWYQQRPGKAPNLLIYAASSLQSGVPSRFSGRGSGTDFTLTISSLQAEDFATYYCQQSYSIPQTFGQGTKLEIKGGGGSGGGGSGGGGSQVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREVTGDLEDAFDIWGQGTMVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 227 - DNA, 3536 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggatatccagatgacccagagcccaagctccctgtccgcctctgtgggcgacagggtgaccatcacatgccgcgccagccagacaatctggtcctacctgaactggtatcagcagagacccggcaaggcccctaatctgctgatctacgcagcatctagcctgcagtctggagtgccctcccggttctctggaagaggatccggaaccgacttcaccctgacaatctcctctctgcaggccgaggacttcgccacatactattgccagcagagctattccatccctcagacctttggccagggcacaaagctggagatcaagggcggcggcggctctggaggaggaggaagcggaggaggaggatcccaggtgcagctgcagcagagcggaccaggactggtgaagccctcccagaccctgtctctgacatgtgccatcagcggcgattccgtgagctccaacagcgccgcctggaattggatccggcagtctcccagcagaggactggagtggctgggaaggacctactatcgctccaagtggtacaacgattatgccgtgtctgtgaagagccggatcaccatcaaccctgacacatctaagaatcagttcagcctgcagctgaattccgtgaccccagaggacacagccgtgtactattgtgcaagggaggtgaccggcgacctggaggatgcctttgacatctggggccagggcaccatggtgacagtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 228 - DNA, 3536 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggatatccagatgacccagagcccaagctccctgtccgcctctgtgggcgacagggtgaccatcacatgccgcgccagccagacaatctggtcctacctgaactggtatcagcagagacccggcaaggcccctaatctgctgatctacgcagcatctagcctgcagtctggagtgccctcccggttctctggaagaggatccggaaccgacttcaccctgacaatctcctctctgcaggccgaggacttcgccacatactattgccagcagagctattccatccctcagacctttggccagggcacaaagctggagatcaagggcggcggcggctctggaggaggaggaagcggaggaggaggatcccaggtgcagctgcagcagagcggaccaggactggtgaagccctcccagaccctgtctctgacatgtgccatcagcggcgattccgtgagctccaacagcgccgcctggaattggatccggcagtctcccagcagaggactggagtggctgggaaggacctactatcgctccaagtggtacaacgattatgccgtgtctgtgaagagccggatcaccatcaaccctgacacatctaagaatcagttcagcctgcagctgaattccgtgaccccagaggacacagccgtgtactattgtgcaagggaggtgaccggcgacctggaggatgcctttgacatctggggccagggcaccatggtgacagtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 229 - protein, 487 aa, Artificial Sequence
  Synthesized
MALPVTALLLPLALLLHAARPDIQMTQSPSSLSASVGDRVTITCRASQTIWSYLNWYQQRPGKAPNLLIYAASSLQSGVPSRFSGRGSGTDFTLTISSLQAEDFATYYCQQSYSIPQTFGQGTKLEIKGGGGSGGGGSGGGGSQVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREVTGDLEDAFDIWGQGTMVTVSSTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 230 - DNA, 3527 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggatatccagatgacccagagcccaagctccctgtccgcctctgtgggcgacagggtgaccatcacatgccgcgccagccagacaatctggtcctacctgaactggtatcagcagagacccggcaaggcccctaatctgctgatctacgcagcatctagcctgcagtctggagtgccctcccggttctctggaagaggatccggaaccgacttcaccctgacaatctcctctctgcaggccgaggacttcgccacatactattgccagcagagctattccatccctcagacctttggccagggcacaaagctggagatcaagggcggcggcggctctggaggaggaggaagcggaggaggaggatcccaggtgcagctgcagcagagcggaccaggactggtgaagccctcccagaccctgtctctgacatgtgccatcagcggcgattccgtgagctccaacagcgccgcctggaattggatccggcagtctcccagcagaggactggagtggctgggaaggacctactatcgctccaagtggtacaacgattatgccgtgtctgtgaagagccggatcaccatcaaccctgacacatctaagaatcagttcagcctgcagctgaattccgtgaccccagaggacacagccgtgtactattgtgcaagggaggtgaccggcgacctggaggatgcctttgacatctggggccagggcaccatggtgacagtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 231 - DNA, 3545 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggatatccagatgacccagagcccaagctccctgtccgcctctgtgggcgacagggtgaccatcacatgccgcgccagccagacaatctggtcctacctgaactggtatcagcagagacccggcaaggcccctaatctgctgatctacgcagcatctagcctgcagtctggagtgccctcccggttctctggaagaggatccggaaccgacttcaccctgacaatctcctctctgcaggccgaggacttcgccacatactattgccagcagagctattccatccctcagacctttggccagggcacaaagctggagatcaagggcggcggcggctctggaggaggaggaagcggaggaggaggatcccaggtgcagctgcagcagagcggaccaggactggtgaagccctcccagaccctgtctctgacatgtgccatcagcggcgattccgtgagctccaacagcgccgcctggaattggatccggcagtctcccagcagaggactggagtggctgggaaggacctactatcgctccaagtggtacaacgattatgccgtgtctgtgaagagccggatcaccatcaaccctgacacatctaagaatcagttcagcctgcagctgaattccgtgaccccagaggacacagccgtgtactattgtgcaagggaggtgaccggcgacctggaggatgcctttgacatctggggccagggcaccatggtgacagtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 232 - DNA, 3536 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggatatccagatgacccagagcccaagctccctgtccgcctctgtgggcgacagggtgaccatcacatgccgcgccagccagacaatctggtcctacctgaactggtatcagcagagacccggcaaggcccctaatctgctgatctacgcagcatctagcctgcagtctggagtgccctcccggttctctggaagaggatccggaaccgacttcaccctgacaatctcctctctgcaggccgaggacttcgccacatactattgccagcagagctattccatccctcagacctttggccagggcacaaagctggagatcaagggcggcggcggctctggaggaggaggaagcggaggaggaggatcccaggtgcagctgcagcagagcggaccaggactggtgaagccctcccagaccctgtctctgacatgtgccatcagcggcgattccgtgagctccaacagcgccgcctggaattggatccggcagtctcccagcagaggactggagtggctgggaaggacctactatcgctccaagtggtacaacgattatgccgtgtctgtgaagagccggatcaccatcaaccctgacacatctaagaatcagttcagcctgcagctgaattccgtgaccccagaggacacagccgtgtactattgtgcaagggaggtgaccggcgacctggaggatgcctttgacatctggggccagggcaccatggtgacagtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 233 - DNA, 3536 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggatatccagatgacccagagcccaagctccctgtccgcctctgtgggcgacagggtgaccatcacatgccgcgccagccagacaatctggtcctacctgaactggtatcagcagagacccggcaaggcccctaatctgctgatctacgcagcatctagcctgcagtctggagtgccctcccggttctctggaagaggatccggaaccgacttcaccctgacaatctcctctctgcaggccgaggacttcgccacatactattgccagcagagctattccatccctcagacctttggccagggcacaaagctggagatcaagggcggcggcggctctggaggaggaggaagcggaggaggaggatcccaggtgcagctgcagcagagcggaccaggactggtgaagccctcccagaccctgtctctgacatgtgccatcagcggcgattccgtgagctccaacagcgccgcctggaattggatccggcagtctcccagcagaggactggagtggctgggaaggacctactatcgctccaagtggtacaacgattatgccgtgtctgtgaagagccggatcaccatcaaccctgacacatctaagaatcagttcagcctgcagctgaattccgtgaccccagaggacacagccgtgtactattgtgcaagggaggtgaccggcgacctggaggatgcctttgacatctggggccagggcaccatggtgacagtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 234 - DNA, 3527 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggatatccagatgacccagagcccaagctccctgtccgcctctgtgggcgacagggtgaccatcacatgccgcgccagccagacaatctggtcctacctgaactggtatcagcagagacccggcaaggcccctaatctgctgatctacgcagcatctagcctgcagtctggagtgccctcccggttctctggaagaggatccggaaccgacttcaccctgacaatctcctctctgcaggccgaggacttcgccacatactattgccagcagagctattccatccctcagacctttggccagggcacaaagctggagatcaagggcggcggcggctctggaggaggaggaagcggaggaggaggatcccaggtgcagctgcagcagagcggaccaggactggtgaagccctcccagaccctgtctctgacatgtgccatcagcggcgattccgtgagctccaacagcgccgcctggaattggatccggcagtctcccagcagaggactggagtggctgggaaggacctactatcgctccaagtggtacaacgattatgccgtgtctgtgaagagccggatcaccatcaaccctgacacatctaagaatcagttcagcctgcagctgaattccgtgaccccagaggacacagccgtgtactattgtgcaagggaggtgaccggcgacctggaggatgcctttgacatctggggccagggcaccatggtgacagtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 235 - DNA, 3665 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccgatgggctggtcctgcatcatcctgttcctggtggccaccgccaccggcgtgcactccaacatcgtgctgacccagtcccccgcctccctggccgtgtccctgggccagcgggccaccatctcctgccgggcctccgagtccgtggactcctacggcaactccttcatgcactggtaccagcagaagcccggccagccccccaagctgctgatctacctggcctccaacctggagtccggcgtgcccgcccggttctccggctccggctcccggaccgacttcaccctgaccatcgaccccgtggaggccgacgacgtggccacctactactgccagcagaacaacggcgacccctacaccttcggcggcggcaccaagctggagatcatccggggcggcggcggctccggcggcggcggctccggcggcggcggctccatgggctggtcctgcatcatcctgttcctggtggccaccgccaccggcgtgcactccgaggtgcagctggtggagtccggcggcggcctgatgcagcccaagggctccctgaagctgtcctgcgccgcctccggcttcaccttcaagacctacgccctgaactgggtgcggcaggcccccggcaccggcctggagtgggtggcccggatccggtccaagtccaacaactacaccacctactacgccgactccgtgaaggaccggttcaccatctcccgggacgactcccagaacatgctgtacctgcagatgaacaacctgaagaccgaggacaccgccatgtactactgcgtgcggccccagtccggcacctccttcgcctactggggccagggcaccctggtgaccgtgtccgccgccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 236 - protein, 530 aa, Artificial Sequence
  Synthesized
MALPVTALLLPLALLLHAARPMGWSCIILFLVATATGVHSNIVLTQSPASLAVSLGQRATISCRASESVDSYGNSFMHWYQQKPGQPPKLLIYLASNLESGVPARFSGSGSRTDFTLTIDPVEADDVATYYCQQNNGDPYTFGGGTKLEIIRGGGGSGGGGSGGGGSMGWSCIILFLVATATGVHSEVQLVESGGGLMQPKGSLKLSCAASGFTFKTYALNWVRQAPGTGLEWVARIRSKSNNYTTYYADSVKDRFTISRDDSQNMLYLQMNNLKTEDTAMYYCVRPQSGTSFAYWGQGTLVTVSAATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 237 - DNA, 3656 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccgatgggctggtcctgcatcatcctgttcctggtggccaccgccaccggcgtgcactccaacatcgtgctgacccagtcccccgcctccctggccgtgtccctgggccagcgggccaccatctcctgccgggcctccgagtccgtggactcctacggcaactccttcatgcactggtaccagcagaagcccggccagccccccaagctgctgatctacctggcctccaacctggagtccggcgtgcccgcccggttctccggctccggctcccggaccgacttcaccctgaccatcgaccccgtggaggccgacgacgtggccacctactactgccagcagaacaacggcgacccctacaccttcggcggcggcaccaagctggagatcatccggggcggcggcggctccggcggcggcggctccggcggcggcggctccatgggctggtcctgcatcatcctgttcctggtggccaccgccaccggcgtgcactccgaggtgcagctggtggagtccggcggcggcctgatgcagcccaagggctccctgaagctgtcctgcgccgcctccggcttcaccttcaagacctacgccctgaactgggtgcggcaggcccccggcaccggcctggagtgggtggcccggatccggtccaagtccaacaactacaccacctactacgccgactccgtgaaggaccggttcaccatctcccgggacgactcccagaacatgctgtacctgcagatgaacaacctgaagaccgaggacaccgccatgtactactgcgtgcggccccagtccggcacctccttcgcctactggggccagggcaccctggtgaccgtgtccgccgccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 238 - DNA, 3656 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccgatgggctggtcctgcatcatcctgttcctggtggccaccgccaccggcgtgcactccaacatcgtgctgacccagtcccccgcctccctggccgtgtccctgggccagcgggccaccatctcctgccgggcctccgagtccgtggactcctacggcaactccttcatgcactggtaccagcagaagcccggccagccccccaagctgctgatctacctggcctccaacctggagtccggcgtgcccgcccggttctccggctccggctcccggaccgacttcaccctgaccatcgaccccgtggaggccgacgacgtggccacctactactgccagcagaacaacggcgacccctacaccttcggcggcggcaccaagctggagatcatccggggcggcggcggctccggcggcggcggctccggcggcggcggctccatgggctggtcctgcatcatcctgttcctggtggccaccgccaccggcgtgcactccgaggtgcagctggtggagtccggcggcggcctgatgcagcccaagggctccctgaagctgtcctgcgccgcctccggcttcaccttcaagacctacgccctgaactgggtgcggcaggcccccggcaccggcctggagtgggtggcccggatccggtccaagtccaacaactacaccacctactacgccgactccgtgaaggaccggttcaccatctcccgggacgactcccagaacatgctgtacctgcagatgaacaacctgaagaccgaggacaccgccatgtactactgcgtgcggccccagtccggcacctccttcgcctactggggccagggcaccctggtgaccgtgtccgccgccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 239 - protein, 527 aa, Artificial Sequence
  Synthesized
MALPVTALLLPLALLLHAARPMGWSCIILFLVATATGVHSNIVLTQSPASLAVSLGQRATISCRASESVDSYGNSFMHWYQQKPGQPPKLLIYLASNLESGVPARFSGSGSRTDFTLTIDPVEADDVATYYCQQNNGDPYTFGGGTKLEIIRGGGGSGGGGSGGGGSMGWSCIILFLVATATGVHSEVQLVESGGGLMQPKGSLKLSCAASGFTFKTYALNWVRQAPGTGLEWVARIRSKSNNYTTYYADSVKDRFTISRDDSQNMLYLQMNNLKTEDTAMYYCVRPQSGTSFAYWGQGTLVTVSAATTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 240 - DNA, 3665 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccgatgggctggtcctgcatcatcctgttcctggtggccaccgccaccggcgtgcactccaacatcgtgctgacccagtcccccgcctccctggccgtgtccctgggccagcgggccaccatctcctgccgggcctccgagtccgtggactcctacggcaactccttcatgcactggtaccagcagaagcccggccagccccccaagctgctgatctacctggcctccaacctggagtccggcgtgcccgcccggttctccggctccggctcccggaccgacttcaccctgaccatcgaccccgtggaggccgacgacgtggccacctactactgccagcagaacaacggcgacccctacaccttcggcggcggcaccaagctggagatcatccggggcggcggcggctccggcggcggcggctccggcggcggcggctccatgggctggtcctgcatcatcctgttcctggtggccaccgccaccggcgtgcactccgaggtgcagctggtggagtccggcggcggcctgatgcagcccaagggctccctgaagctgtcctgcgccgcctccggcttcaccttcaagacctacgccctgaactgggtgcggcaggcccccggcaccggcctggagtgggtggcccggatccggtccaagtccaacaactacaccacctactacgccgactccgtgaaggaccggttcaccatctcccgggacgactcccagaacatgctgtacctgcagatgaacaacctgaagaccgaggacaccgccatgtactactgcgtgcggccccagtccggcacctccttcgcctactggggccagggcaccctggtgaccgtgtccgccgccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 241 - DNA, 3656 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccgatgggctggtcctgcatcatcctgttcctggtggccaccgccaccggcgtgcactccaacatcgtgctgacccagtcccccgcctccctggccgtgtccctgggccagcgggccaccatctcctgccgggcctccgagtccgtggactcctacggcaactccttcatgcactggtaccagcagaagcccggccagccccccaagctgctgatctacctggcctccaacctggagtccggcgtgcccgcccggttctccggctccggctcccggaccgacttcaccctgaccatcgaccccgtggaggccgacgacgtggccacctactactgccagcagaacaacggcgacccctacaccttcggcggcggcaccaagctggagatcatccggggcggcggcggctccggcggcggcggctccggcggcggcggctccatgggctggtcctgcatcatcctgttcctggtggccaccgccaccggcgtgcactccgaggtgcagctggtggagtccggcggcggcctgatgcagcccaagggctccctgaagctgtcctgcgccgcctccggcttcaccttcaagacctacgccctgaactgggtgcggcaggcccccggcaccggcctggagtgggtggcccggatccggtccaagtccaacaactacaccacctactacgccgactccgtgaaggaccggttcaccatctcccgggacgactcccagaacatgctgtacctgcagatgaacaacctgaagaccgaggacaccgccatgtactactgcgtgcggccccagtccggcacctccttcgcctactggggccagggcaccctggtgaccgtgtccgccgccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 242 - DNA, 3656 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccgatgggctggtcctgcatcatcctgttcctggtggccaccgccaccggcgtgcactccaacatcgtgctgacccagtcccccgcctccctggccgtgtccctgggccagcgggccaccatctcctgccgggcctccgagtccgtggactcctacggcaactccttcatgcactggtaccagcagaagcccggccagccccccaagctgctgatctacctggcctccaacctggagtccggcgtgcccgcccggttctccggctccggctcccggaccgacttcaccctgaccatcgaccccgtggaggccgacgacgtggccacctactactgccagcagaacaacggcgacccctacaccttcggcggcggcaccaagctggagatcatccggggcggcggcggctccggcggcggcggctccggcggcggcggctccatgggctggtcctgcatcatcctgttcctggtggccaccgccaccggcgtgcactccgaggtgcagctggtggagtccggcggcggcctgatgcagcccaagggctccctgaagctgtcctgcgccgcctccggcttcaccttcaagacctacgccctgaactgggtgcggcaggcccccggcaccggcctggagtgggtggcccggatccggtccaagtccaacaactacaccacctactacgccgactccgtgaaggaccggttcaccatctcccgggacgactcccagaacatgctgtacctgcagatgaacaacctgaagaccgaggacaccgccatgtactactgcgtgcggccccagtccggcacctccttcgcctactggggccagggcaccctggtgaccgtgtccgccgccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 243 - DNA, 3647 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccgatgggctggtcctgcatcatcctgttcctggtggccaccgccaccggcgtgcactccaacatcgtgctgacccagtcccccgcctccctggccgtgtccctgggccagcgggccaccatctcctgccgggcctccgagtccgtggactcctacggcaactccttcatgcactggtaccagcagaagcccggccagccccccaagctgctgatctacctggcctccaacctggagtccggcgtgcccgcccggttctccggctccggctcccggaccgacttcaccctgaccatcgaccccgtggaggccgacgacgtggccacctactactgccagcagaacaacggcgacccctacaccttcggcggcggcaccaagctggagatcatccggggcggcggcggctccggcggcggcggctccggcggcggcggctccatgggctggtcctgcatcatcctgttcctggtggccaccgccaccggcgtgcactccgaggtgcagctggtggagtccggcggcggcctgatgcagcccaagggctccctgaagctgtcctgcgccgcctccggcttcaccttcaagacctacgccctgaactgggtgcggcaggcccccggcaccggcctggagtgggtggcccggatccggtccaagtccaacaactacaccacctactacgccgactccgtgaaggaccggttcaccatctcccgggacgactcccagaacatgctgtacctgcagatgaacaacctgaagaccgaggacaccgccatgtactactgcgtgcggccccagtccggcacctccttcgcctactggggccagggcaccctggtgaccgtgtccgccgccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 244 - DNA, 3518 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggacatccagctcacccagtccccgagctcgctgtccgcctccgtgggagatcgggtcaccatcacgtgccgcgccagccagtcgatttcctcctacctgaactggtaccaacagaagcccggaaaagccccgaagcttctcatctacgccgcctcgagcctgcagtcaggagtgccctcacggttctccggctccggttccggtactgatttcaccctgaccatttcctccctgcaaccggaggacttcgctacttactactgccagcagtcgtactccaccccctacactttcggacaaggcaccaaggtcgaaatcaagggtggcggtggctcgggcggtggtgggtcgggtggcggcggatctgaagtgcaattggtggaatcagggggaggacttgtgcagcctggaggatcgctgagactgtcatgtgccgtgtccggctttgccctgtccaaccacgggatgtcctgggtccgccgcgcgcctggaaagggcctcgaatgggtgtcgggtattgtgtacagcggtagcacctactatgccgcatccgtgaaggggagattcaccatcagccgggacaactccaggaacactctgtacctccaaatgaattcgctgaggccagaggacactgccatctactactgctccgcgcatggcggagagtccgacgtctggggacaggggaccaccgtgaccgtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 245 - protein, 482 aa, Artificial Sequence
  Synthesized
MALPVTALLLPLALLLHAARPEIVLTQSPGTLSLSPGERATLSCRGGQSVSSSYLAWYQQKPGQAPRLLMYDASIRATGIPDRFSGSGSGTDFTLTISRLEPEDFAVYYCQQYQSWPLTFGQGTKVEIKGGGGSGGGGSGGGGSEVQLLESGGGLVQPGGSLRLSCAASGFTFSSYAMNWVRQAPGKGLEWVSAILSSGGSTYYADSVKGRFTISRDNSKNTLYLQMNSLRAEDTAVYYCARYWPMDIWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 246 - DNA, 3509 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggacatccagctcacccagtccccgagctcgctgtccgcctccgtgggagatcgggtcaccatcacgtgccgcgccagccagtcgatttcctcctacctgaactggtaccaacagaagcccggaaaagccccgaagcttctcatctacgccgcctcgagcctgcagtcaggagtgccctcacggttctccggctccggttccggtactgatttcaccctgaccatttcctccctgcaaccggaggacttcgctacttactactgccagcagtcgtactccaccccctacactttcggacaaggcaccaaggtcgaaatcaagggtggcggtggctcgggcggtggtgggtcgggtggcggcggatctgaagtgcaattggtggaatcagggggaggacttgtgcagcctggaggatcgctgagactgtcatgtgccgtgtccggctttgccctgtccaaccacgggatgtcctgggtccgccgcgcgcctggaaagggcctcgaatgggtgtcgggtattgtgtacagcggtagcacctactatgccgcatccgtgaaggggagattcaccatcagccgggacaactccaggaacactctgtacctccaaatgaattcgctgaggccagaggacactgccatctactactgctccgcgcatggcggagagtccgacgtctggggacaggggaccaccgtgaccgtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 247 - DNA, 3509 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggacatccagctcacccagtccccgagctcgctgtccgcctccgtgggagatcgggtcaccatcacgtgccgcgccagccagtcgatttcctcctacctgaactggtaccaacagaagcccggaaaagccccgaagcttctcatctacgccgcctcgagcctgcagtcaggagtgccctcacggttctccggctccggttccggtactgatttcaccctgaccatttcctccctgcaaccggaggacttcgctacttactactgccagcagtcgtactccaccccctacactttcggacaaggcaccaaggtcgaaatcaagggtggcggtggctcgggcggtggtgggtcgggtggcggcggatctgaagtgcaattggtggaatcagggggaggacttgtgcagcctggaggatcgctgagactgtcatgtgccgtgtccggctttgccctgtccaaccacgggatgtcctgggtccgccgcgcgcctggaaagggcctcgaatgggtgtcgggtattgtgtacagcggtagcacctactatgccgcatccgtgaaggggagattcaccatcagccgggacaactccaggaacactctgtacctccaaatgaattcgctgaggccagaggacactgccatctactactgctccgcgcatggcggagagtccgacgtctggggacaggggaccaccgtgaccgtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 248 - protein, 479 aa, Artificial Sequence
  Synthesized
MALPVTALLLPLALLLHAARPEIVLTQSPGTLSLSPGERATLSCRGGQSVSSSYLAWYQQKPGQAPRLLMYDASIRATGIPDRFSGSGSGTDFTLTISRLEPEDFAVYYCQQYQSWPLTFGQGTKVEIKGGGGSGGGGSGGGGSEVQLLESGGGLVQPGGSLRLSCAASGFTFSSYAMNWVRQAPGKGLEWVSAILSSGGSTYYADSVKGRFTISRDNSKNTLYLQMNSLRAEDTAVYYCARYWPMDIWGQGTLVTVSSTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 249 - DNA, 3500 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggacatccagctcacccagtccccgagctcgctgtccgcctccgtgggagatcgggtcaccatcacgtgccgcgccagccagtcgatttcctcctacctgaactggtaccaacagaagcccggaaaagccccgaagcttctcatctacgccgcctcgagcctgcagtcaggagtgccctcacggttctccggctccggttccggtactgatttcaccctgaccatttcctccctgcaaccggaggacttcgctacttactactgccagcagtcgtactccaccccctacactttcggacaaggcaccaaggtcgaaatcaagggtggcggtggctcgggcggtggtgggtcgggtggcggcggatctgaagtgcaattggtggaatcagggggaggacttgtgcagcctggaggatcgctgagactgtcatgtgccgtgtccggctttgccctgtccaaccacgggatgtcctgggtccgccgcgcgcctggaaagggcctcgaatgggtgtcgggtattgtgtacagcggtagcacctactatgccgcatccgtgaaggggagattcaccatcagccgggacaactccaggaacactctgtacctccaaatgaattcgctgaggccagaggacactgccatctactactgctccgcgcatggcggagagtccgacgtctggggacaggggaccaccgtgaccgtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 250 - DNA, 3518 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggacatccagctcacccagtccccgagctcgctgtccgcctccgtgggagatcgggtcaccatcacgtgccgcgccagccagtcgatttcctcctacctgaactggtaccaacagaagcccggaaaagccccgaagcttctcatctacgccgcctcgagcctgcagtcaggagtgccctcacggttctccggctccggttccggtactgatttcaccctgaccatttcctccctgcaaccggaggacttcgctacttactactgccagcagtcgtactccaccccctacactttcggacaaggcaccaaggtcgaaatcaagggtggcggtggctcgggcggtggtgggtcgggtggcggcggatctgaagtgcaattggtggaatcagggggaggacttgtgcagcctggaggatcgctgagactgtcatgtgccgtgtccggctttgccctgtccaaccacgggatgtcctgggtccgccgcgcgcctggaaagggcctcgaatgggtgtcgggtattgtgtacagcggtagcacctactatgccgcatccgtgaaggggagattcaccatcagccgggacaactccaggaacactctgtacctccaaatgaattcgctgaggccagaggacactgccatctactactgctccgcgcatggcggagagtccgacgtctggggacaggggaccaccgtgaccgtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 251 - DNA, 3509 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggacatccagctcacccagtccccgagctcgctgtccgcctccgtgggagatcgggtcaccatcacgtgccgcgccagccagtcgatttcctcctacctgaactggtaccaacagaagcccggaaaagccccgaagcttctcatctacgccgcctcgagcctgcagtcaggagtgccctcacggttctccggctccggttccggtactgatttcaccctgaccatttcctccctgcaaccggaggacttcgctacttactactgccagcagtcgtactccaccccctacactttcggacaaggcaccaaggtcgaaatcaagggtggcggtggctcgggcggtggtgggtcgggtggcggcggatctgaagtgcaattggtggaatcagggggaggacttgtgcagcctggaggatcgctgagactgtcatgtgccgtgtccggctttgccctgtccaaccacgggatgtcctgggtccgccgcgcgcctggaaagggcctcgaatgggtgtcgggtattgtgtacagcggtagcacctactatgccgcatccgtgaaggggagattcaccatcagccgggacaactccaggaacactctgtacctccaaatgaattcgctgaggccagaggacactgccatctactactgctccgcgcatggcggagagtccgacgtctggggacaggggaccaccgtgaccgtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 252 - DNA, 3509 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggacatccagctcacccagtccccgagctcgctgtccgcctccgtgggagatcgggtcaccatcacgtgccgcgccagccagtcgatttcctcctacctgaactggtaccaacagaagcccggaaaagccccgaagcttctcatctacgccgcctcgagcctgcagtcaggagtgccctcacggttctccggctccggttccggtactgatttcaccctgaccatttcctccctgcaaccggaggacttcgctacttactactgccagcagtcgtactccaccccctacactttcggacaaggcaccaaggtcgaaatcaagggtggcggtggctcgggcggtggtgggtcgggtggcggcggatctgaagtgcaattggtggaatcagggggaggacttgtgcagcctggaggatcgctgagactgtcatgtgccgtgtccggctttgccctgtccaaccacgggatgtcctgggtccgccgcgcgcctggaaagggcctcgaatgggtgtcgggtattgtgtacagcggtagcacctactatgccgcatccgtgaaggggagattcaccatcagccgggacaactccaggaacactctgtacctccaaatgaattcgctgaggccagaggacactgccatctactactgctccgcgcatggcggagagtccgacgtctggggacaggggaccaccgtgaccgtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 253 - DNA, 3500 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggacatccagctcacccagtccccgagctcgctgtccgcctccgtgggagatcgggtcaccatcacgtgccgcgccagccagtcgatttcctcctacctgaactggtaccaacagaagcccggaaaagccccgaagcttctcatctacgccgcctcgagcctgcagtcaggagtgccctcacggttctccggctccggttccggtactgatttcaccctgaccatttcctccctgcaaccggaggacttcgctacttactactgccagcagtcgtactccaccccctacactttcggacaaggcaccaaggtcgaaatcaagggtggcggtggctcgggcggtggtgggtcgggtggcggcggatctgaagtgcaattggtggaatcagggggaggacttgtgcagcctggaggatcgctgagactgtcatgtgccgtgtccggctttgccctgtccaaccacgggatgtcctgggtccgccgcgcgcctggaaagggcctcgaatgggtgtcgggtattgtgtacagcggtagcacctactatgccgcatccgtgaaggggagattcaccatcagccgggacaactccaggaacactctgtacctccaaatgaattcgctgaggccagaggacactgccatctactactgctccgcgcatggcggagagtccgacgtctggggacaggggaccaccgtgaccgtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 254 - DNA, 3545 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggagatcgtgatgacccagtcccccctgtccctgcccgtgacccccggcgagcccgcctccatctcctgccggtcctcccagtccctgctgcactccaacggctacaactacctggactggtacctgcagaagcccggccagtccccccagctgctgatctacctgggctccaaccgggcctccggcgtgcccgaccggttctccggctccggctccggcaccgacttcaccctgaagatctcccgggtggaggccgaggacgtgggcgtgtactactgcatgcaggccctgcagacccccaccttcggccccggcaccaaggtggacatcaagggcggcggcggctccggcggcggcggctccggcggcggcggctcccaggtgcagctggtgcagtccggcggcggcgtggtgcagcccggcaagtccctgcggctgtcctgcgccgcctccggcttcaccttctccatcttcgccatgcactgggtgcggcaggcccccggcaagggcctggagtgggtggccaccatctcctacgacggctccaacgccttctacgccgactccgtggagggccggttcaccatctcccgggacaactccaaggactccctgtacctgcagatggactccctgcggcccgaggacaccgccgtgtactactgcgtgaaggccggcgacggcggctacgacgtgttcgactcctggggccagggcaccctggtgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 255 - protein, 490 aa, Artificial Sequence
  Synthesized
MALPVTALLLPLALLLHAARPEIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPTFGPGTKVDIKGGGGSGGGGSGGGGSQVQLVQSGGGVVQPGKSLRLSCAASGFTFSIFAMHWVRQAPGKGLEWVATISYDGSNAFYADSVEGRFTISRDNSKDSLYLQMDSLRPEDTAVYYCVKAGDGGYDVFDSWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 256 - DNA, 3536 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggagatcgtgatgacccagtcccccctgtccctgcccgtgacccccggcgagcccgcctccatctcctgccggtcctcccagtccctgctgcactccaacggctacaactacctggactggtacctgcagaagcccggccagtccccccagctgctgatctacctgggctccaaccgggcctccggcgtgcccgaccggttctccggctccggctccggcaccgacttcaccctgaagatctcccgggtggaggccgaggacgtgggcgtgtactactgcatgcaggccctgcagacccccaccttcggccccggcaccaaggtggacatcaagggcggcggcggctccggcggcggcggctccggcggcggcggctcccaggtgcagctggtgcagtccggcggcggcgtggtgcagcccggcaagtccctgcggctgtcctgcgccgcctccggcttcaccttctccatcttcgccatgcactgggtgcggcaggcccccggcaagggcctggagtgggtggccaccatctcctacgacggctccaacgccttctacgccgactccgtggagggccggttcaccatctcccgggacaactccaaggactccctgtacctgcagatggactccctgcggcccgaggacaccgccgtgtactactgcgtgaaggccggcgacggcggctacgacgtgttcgactcctggggccagggcaccctggtgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 257 - DNA, 3536 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggagatcgtgatgacccagtcccccctgtccctgcccgtgacccccggcgagcccgcctccatctcctgccggtcctcccagtccctgctgcactccaacggctacaactacctggactggtacctgcagaagcccggccagtccccccagctgctgatctacctgggctccaaccgggcctccggcgtgcccgaccggttctccggctccggctccggcaccgacttcaccctgaagatctcccgggtggaggccgaggacgtgggcgtgtactactgcatgcaggccctgcagacccccaccttcggccccggcaccaaggtggacatcaagggcggcggcggctccggcggcggcggctccggcggcggcggctcccaggtgcagctggtgcagtccggcggcggcgtggtgcagcccggcaagtccctgcggctgtcctgcgccgcctccggcttcaccttctccatcttcgccatgcactgggtgcggcaggcccccggcaagggcctggagtgggtggccaccatctcctacgacggctccaacgccttctacgccgactccgtggagggccggttcaccatctcccgggacaactccaaggactccctgtacctgcagatggactccctgcggcccgaggacaccgccgtgtactactgcgtgaaggccggcgacggcggctacgacgtgttcgactcctggggccagggcaccctggtgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 258 - protein, 487 aa, Artificial Sequence
  Synthesized
MALPVTALLLPLALLLHAARPEIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPTFGPGTKVDIKGGGGSGGGGSGGGGSQVQLVQSGGGVVQPGKSLRLSCAASGFTFSIFAMHWVRQAPGKGLEWVATISYDGSNAFYADSVEGRFTISRDNSKDSLYLQMDSLRPEDTAVYYCVKAGDGGYDVFDSWGQGTLVTVSSTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 259 - DNA, 3527 bp, Artificial Sequence
  Synthesized
atggccttaccagtgaccgccttgctcctgccgctggccttgctgctccacgccgccaggccggatattgtgatgacccagtccccgtcctccctgaccgtgaccgcgggcgaaaaagtgaccatgatttgcaaatcctcccagtccctgctgaattccggcgatcagaaaaattatctgacctggtatcagcagaaaccgggccagccgccgaaactgctgattttttgggcgtccacccgtgaatccggcgtgccggatcgttttaccggctccggctccggcaccgattttaccctgaccatttcctccgtgcaggcggaagatctggcggtgtattattgccagaatgattattcctatccgctgacctttggcgcgggcaccaaactggaactgaaaggcggcggcggctccggcggcggcggctccggcggcggcggctcccaggtgcagctgcagcagtccgatgcggaactggtgaaaccgggctcctccgtgaaaatttcctgcaaagcgtccggctatacctttaccgatcatgcgattcattgggtgaaacagaaaccggaacagggcctggaatggattggccatttttccccgggcaataccgatattaaatataatgataaatttaaaggcaaagcgaccctgaccgtggatcgttcctcctccaccgcgtatatgcagctgaattccctgacctccgaagattccgcggtgtatttttgcaaaacctccacctttttttttgattattggggccagggcaccaccctgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggagatcgtgatgacccagtcccccctgtccctgcccgtgacccccggcgagcccgcctccatctcctgccggtcctcccagtccctgctgcactccaacggctacaactacctggactggtacctgcagaagcccggccagtccccccagctgctgatctacctgggctccaaccgggcctccggcgtgcccgaccggttctccggctccggctccggcaccgacttcaccctgaagatctcccgggtggaggccgaggacgtgggcgtgtactactgcatgcaggccctgcagacccccaccttcggccccggcaccaaggtggacatcaagggcggcggcggctccggcggcggcggctccggcggcggcggctcccaggtgcagctggtgcagtccggcggcggcgtggtgcagcccggcaagtccctgcggctgtcctgcgccgcctccggcttcaccttctccatcttcgccatgcactgggtgcggcaggcccccggcaagggcctggagtgggtggccaccatctcctacgacggctccaacgccttctacgccgactccgtggagggccggttcaccatctcccgggacaactccaaggactccctgtacctgcagatggactccctgcggcccgaggacaccgccgtgtactactgcgtgaaggccggcgacggcggctacgacgtgttcgactcctggggccagggcaccctggtgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 260 - DNA, 3545 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggagatcgtgatgacccagtcccccctgtccctgcccgtgacccccggcgagcccgcctccatctcctgccggtcctcccagtccctgctgcactccaacggctacaactacctggactggtacctgcagaagcccggccagtccccccagctgctgatctacctgggctccaaccgggcctccggcgtgcccgaccggttctccggctccggctccggcaccgacttcaccctgaagatctcccgggtggaggccgaggacgtgggcgtgtactactgcatgcaggccctgcagacccccaccttcggccccggcaccaaggtggacatcaagggcggcggcggctccggcggcggcggctccggcggcggcggctcccaggtgcagctggtgcagtccggcggcggcgtggtgcagcccggcaagtccctgcggctgtcctgcgccgcctccggcttcaccttctccatcttcgccatgcactgggtgcggcaggcccccggcaagggcctggagtgggtggccaccatctcctacgacggctccaacgccttctacgccgactccgtggagggccggttcaccatctcccgggacaactccaaggactccctgtacctgcagatggactccctgcggcccgaggacaccgccgtgtactactgcgtgaaggccggcgacggcggctacgacgtgttcgactcctggggccagggcaccctggtgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 261 - DNA, 3536 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggagatcgtgatgacccagtcccccctgtccctgcccgtgacccccggcgagcccgcctccatctcctgccggtcctcccagtccctgctgcactccaacggctacaactacctggactggtacctgcagaagcccggccagtccccccagctgctgatctacctgggctccaaccgggcctccggcgtgcccgaccggttctccggctccggctccggcaccgacttcaccctgaagatctcccgggtggaggccgaggacgtgggcgtgtactactgcatgcaggccctgcagacccccaccttcggccccggcaccaaggtggacatcaagggcggcggcggctccggcggcggcggctccggcggcggcggctcccaggtgcagctggtgcagtccggcggcggcgtggtgcagcccggcaagtccctgcggctgtcctgcgccgcctccggcttcaccttctccatcttcgccatgcactgggtgcggcaggcccccggcaagggcctggagtgggtggccaccatctcctacgacggctccaacgccttctacgccgactccgtggagggccggttcaccatctcccgggacaactccaaggactccctgtacctgcagatggactccctgcggcccgaggacaccgccgtgtactactgcgtgaaggccggcgacggcggctacgacgtgttcgactcctggggccagggcaccctggtgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 262 - DNA, 3536 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggagatcgtgatgacccagtcccccctgtccctgcccgtgacccccggcgagcccgcctccatctcctgccggtcctcccagtccctgctgcactccaacggctacaactacctggactggtacctgcagaagcccggccagtccccccagctgctgatctacctgggctccaaccgggcctccggcgtgcccgaccggttctccggctccggctccggcaccgacttcaccctgaagatctcccgggtggaggccgaggacgtgggcgtgtactactgcatgcaggccctgcagacccccaccttcggccccggcaccaaggtggacatcaagggcggcggcggctccggcggcggcggctccggcggcggcggctcccaggtgcagctggtgcagtccggcggcggcgtggtgcagcccggcaagtccctgcggctgtcctgcgccgcctccggcttcaccttctccatcttcgccatgcactgggtgcggcaggcccccggcaagggcctggagtgggtggccaccatctcctacgacggctccaacgccttctacgccgactccgtggagggccggttcaccatctcccgggacaactccaaggactccctgtacctgcagatggactccctgcggcccgaggacaccgccgtgtactactgcgtgaaggccggcgacggcggctacgacgtgttcgactcctggggccagggcaccctggtgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 263 - DNA, 3527 bp, Artificial Sequence
  Synthesized
atggccttaccagtgaccgccttgctcctgccgctggccttgctgctccacgccgccaggccggacatcgtgatgacccagtccccctccagcctgacagtgacagccggcgagaaggtgacaatgatctgtaagtccagccagagcctgctgaacagcggcgaccagaagaactacctgacctggtaccagcagaagcctggccagccccccaagctgctgatcttctgggccagcacaagggagagcggcgtgcccgacagattcacaggcagcggcagcggcaccgacttcacactgaccatttcctccgtgcaggccgaggacctcgccgtgtactactgccagaacgactactcctaccccctgacattcggcgccggcaccaaactggagctgaagggtggcggtggctcgggcggtggtgggtcgggtggcggcggatctcaggtgcagctccagcagtccgatgccgagctggtgaagcccggaagcagcgtcaagatcagctgtaaggcctccggctacaccttcacagaccacgccatccactgggtgaagcagaagcccgagcagggcctggagtggatcggccactttagccccggaaacaccgacatcaagtacaacgacaagttcaagggcaaggccaccctgaccgtggacaggagcagcagcaccgcctacatgcagctgaacagcctgacaagcgaggacagcgccgtgtacttctgcaagacctccaccttcttcttcgactactggggccagggaaccaccctgacagtgtccagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaatctagaggcgcgcccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaaacgtctaggccccccgaaccacggggacgtggttttcctttgaaaaacacgatgataatatggccacaacccatatgatggccttaccagtgaccgccttgctcctgccgctggccttgctgctccacgccgccaggccggagatcgtgatgacccagtcccccctgtccctgcccgtgacccccggcgagcccgcctccatctcctgccggtcctcccagtccctgctgcactccaacggctacaactacctggactggtacctgcagaagcccggccagtccccccagctgctgatctacctgggctccaaccgggcctccggcgtgcccgaccggttctccggctccggctccggcaccgacttcaccctgaagatctcccgggtggaggccgaggacgtgggcgtgtactactgcatgcaggccctgcagacccccaccttcggccccggcaccaaggtggacatcaagggcggcggcggctccggcggcggcggctccggcggcggcggctcccaggtgcagctggtgcagtccggcggcggcgtggtgcagcccggcaagtccctgcggctgtcctgcgccgcctccggcttcaccttctccatcttcgccatgcactgggtgcggcaggcccccggcaagggcctggagtgggtggccaccatctcctacgacggctccaacgccttctacgccgactccgtggagggccggttcaccatctcccgggacaactccaaggactccctgtacctgcagatggactccctgcggcccgaggacaccgccgtgtactactgcgtgaaggccggcgacggcggctacgacgtgttcgactcctggggccagggcaccctggtgaccgtgtcctccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 264 - protein, 505 aa, Artificial Sequence
  Synthesized
DIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSGGGGSGGGGSGGGGSDIVMTQAAFSNPVTLGTSASISCRSSKSLLHSNGITYFFWYLQKPGLSPQLLIYQMSNLASGVPDRFSSSGSGTDFTLRISRVEAEDVGVYYCAQNLELPPTFGGGTKLEIKRAGGGGSGGGGSGGGGSEVKLVESGGGLVQPGGSMKLSCVASGFTFSNYWMNWVRQSPEKGLEWVAEIRLKSNNYTTHYAESVKGRFTISRDDSKSSVSLQMNNLRVEDTGIYYCTRHYYFDYWGQGTTLTVSS

SEQ ID NO: 265 - protein, 505 aa, Artificial Sequence
  Synthesized
DIVMTQAAFSNPVTLGTSASISCRSSKSLLHSNGITYFFWYLQKPGLSPQLLIYQMSNLASGVPDRFSSSGSGTDFTLRISRVEAEDVGVYYCAQNLELPPTFGGGTKLEIKRAGGGGSGGGGSGGGGSEVKLVESGGGLVQPGGSMKLSCVASGFTFSNYWMNWVRQSPEKGLEWVAEIRLKSNNYTTHYAESVKGRFTISRDDSKSSVSLQMNNLRVEDTGIYYCTRHYYFDYWGQGTTLTVSSGGGGSGGGGSGGGGSDIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSS

SEQ ID NO: 266 - protein, 69 aa, Artificial Sequence; identical to SEQ ID NO: 30
  Synthesized

SEQ ID NO: 267 - protein, 66 aa, Artificial Sequence; identical to SEQ ID NO: 29
  Synthesized

SEQ ID NO: 268 - protein, 69 aa, Artificial Sequence; identical to SEQ ID NO: 2
  Synthesized

SEQ ID NO: 269 - protein, 72 aa, Artificial Sequence; identical to SEQ ID NO: 31
  Synthesized

SEQ ID NO: 270 - protein, 728 aa, Artificial Sequence
  Synthesized
DIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSGGGGSGGGGSGGGGSDIVMTQAAFSNPVTLGTSASISCRSSKSLLHSNGITYFFWYLQKPGLSPQLLIYQMSNLASGVPDRFSSSGSGTDFTLRISRVEAEDVGVYYCAQNLELPPTFGGGTKLEIKRAGGGGSGGGGSGGGGSEVKLVESGGGLVQPGGSMKLSCVASGFTFSNYWMNWVRQSPEKGLEWVAEIRLKSNNYTTHYAESVKGRFTISRDDSKSSVSLQMNNLRVEDTGIYYCTRHYYFDYWGQGTTLTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 271 - protein, 725 aa, Artificial Sequence
  Synthesized
DIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSGGGGSGGGGSGGGGSDIVMTQAAFSNPVTLGTSASISCRSSKSLLHSNGITYFFWYLQKPGLSPQLLIYQMSNLASGVPDRFSSSGSGTDFTLRISRVEAEDVGVYYCAQNLELPPTFGGGTKLEIKRAGGGGSGGGGSGGGGSEVKLVESGGGLVQPGGSMKLSCVASGFTFSNYWMNWVRQSPEKGLEWVAEIRLKSNNYTTHYAESVKGRFTISRDDSKSSVSLQMNNLRVEDTGIYYCTRHYYFDYWGQGTTLTVSSTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 272 - protein, 728 aa, Artificial Sequence
  Synthesized
DIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSGGGGSGGGGSGGGGSDIVMTQAAFSNPVTLGTSASISCRSSKSLLHSNGITYFFWYLQKPGLSPQLLIYQMSNLASGVPDRFSSSGSGTDFTLRISRVEAEDVGVYYCAQNLELPPTFGGGTKLEIKRAGGGGSGGGGSGGGGSEVKLVESGGGLVQPGGSMKLSCVASGFTFSNYWMNWVRQSPEKGLEWVAEIRLKSNNYTTHYAESVKGRFTISRDDSKSSVSLQMNNLRVEDTGIYYCTRHYYFDYWGQGTTLTVSSAKPTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 273 - protein, 731 aa, Artificial Sequence
  Synthesized
DIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSGGGGSGGGGSGGGGSDIVMTQAAFSNPVTLGTSASISCRSSKSLLHSNGITYFFWYLQKPGLSPQLLIYQMSNLASGVPDRFSSSGSGTDFTLRISRVEAEDVGVYYCAQNLELPPTFGGGTKLEIKRAGGGGSGGGGSGGGGSEVKLVESGGGLVQPGGSMKLSCVASGFTFSNYWMNWVRQSPEKGLEWVAEIRLKSNNYTTHYAESVKGRFTISRDDSKSSVSLQMNNLRVEDTGIYYCTRHYYFDYWGQGTTLTVSSAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 274 - protein, 728 aa, Artificial Sequence
  Synthesized
DIVMTQAAFSNPVTLGTSASISCRSSKSLLHSNGITYFFWYLQKPGLSPQLLIYQMSNLASGVPDRFSSSGSGTDFTLRISRVEAEDVGVYYCAQNLELPPTFGGGTKLEIKRAGGGGSGGGGSGGGGSEVKLVESGGGLVQPGGSMKLSCVASGFTFSNYWMNWVRQSPEKGLEWVAEIRLKSNNYTTHYAESVKGRFTISRDDSKSSVSLQMNNLRVEDTGIYYCTRHYYFDYWGQGTTLTVSSGGGGSGGGGSGGGGSDIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 275 - protein, 725 aa, Artificial Sequence
  Synthesized
DIVMTQAAFSNPVTLGTSASISCRSSKSLLHSNGITYFFWYLQKPGLSPQLLIYQMSNLASGVPDRFSSSGSGTDFTLRISRVEAEDVGVYYCAQNLELPPTFGGGTKLEIKRAGGGGSGGGGSGGGGSEVKLVESGGGLVQPGGSMKLSCVASGFTFSNYWMNWVRQSPEKGLEWVAEIRLKSNNYTTHYAESVKGRFTISRDDSKSSVSLQMNNLRVEDTGIYYCTRHYYFDYWGQGTTLTVSSGGGGSGGGGSGGGGSDIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 276 - protein, 728 aa, Artificial Sequence
  Synthesized
DIVMTQAAFSNPVTLGTSASISCRSSKSLLHSNGITYFFWYLQKPGLSPQLLIYQMSNLASGVPDRFSSSGSGTDFTLRISRVEAEDVGVYYCAQNLELPPTFGGGTKLEIKRAGGGGSGGGGSGGGGSEVKLVESGGGLVQPGGSMKLSCVASGFTFSNYWMNWVRQSPEKGLEWVAEIRLKSNNYTTHYAESVKGRFTISRDDSKSSVSLQMNNLRVEDTGIYYCTRHYYFDYWGQGTTLTVSSGGGGSGGGGSGGGGSDIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSAKPTTTPAPRPPTPAPTIASQPLSLRPEACRPAAGGAVHTRGLDFACDIYIWAPLAGTCGVLLLSLVITKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 277 - protein, 731 aa, Artificial Sequence
  Synthesized
DIVMTQAAFSNPVTLGTSASISCRSSKSLLHSNGITYFFWYLQKPGLSPQLLIYQMSNLASGVPDRFSSSGSGTDFTLRISRVEAEDVGVYYCAQNLELPPTFGGGTKLEIKRAGGGGSGGGGSGGGGSEVKLVESGGGLVQPGGSMKLSCVASGFTFSNYWMNWVRQSPEKGLEWVAEIRLKSNNYTTHYAESVKGRFTISRDDSKSSVSLQMNNLRVEDTGIYYCTRHYYFDYWGQGTTLTVSSGGGGSGGGGSGGGGSDIVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKGGGGSGGGGSGGGGSQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 278 - protein, 5 aa, Artificial Sequence
  Synthesized
GGGGS

SEQ ID NO: 279 - DNA, 1470 bp, Artificial Sequence
  Synthesized
atggccttaccagtgaccgccttgctcctgccgctggccttgctgctccacgccgccaggccgcagtccgtgctgacccagccaccttccgtgtctgccgctccaggccagaaggtgacaatcagctgctccggcagctcctctgacatcggaagcaactacgtgtcctggtaccagcagttcccaggcaccgcccccaagctgctgatctacgacaacaacaagaggcctagcgccatcccagatagattttctggcagcaagtccggaacctccgccacactgggcatcaccggactgcagacaggcgacgaggctgattactactgcggcacatgggattccaggctgggaatcgccgtgttcggaggaggaacccagctgacagtgctgggcggaggaggaggaagcggaggaggaggatccggaggaggaggatctgaggtgcagctggtgcagtctggcgccgaggtgaagaagcctggacagtctctgaagatcagctgtaaggcttccggctactctctgaccgacaactggatcggatgggtgcggcagaagccaggcaagggactggagtggatgggcatcatctacccaggagactctgatacacgctactctcccagctttcagggccaggtgaccatctccgccgataagtctatcaacacagcttacctgcagtggagctccctgaaggccagcgacaccgctatctactactgcgtgggcctggattggaactacaacccactgaggtactggggacctggaaccctggtgacagtgtctagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagaggcgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 280 - protein, 196 aa, Artificial Sequence; identical to SEQ ID NO: 96
  Synthesized

SEQ ID NO: 281 - protein, 196 aa, Artificial Sequence; identical to SEQ ID NO: 98
  Synthesized

SEQ ID NO: 282 - protein, 196 aa, Flavobacterium ameridies; identical to SEQ ID NO: 97

SEQ ID NO: 283 - DNA, 24 bp, Homo sapiens
ggctcctgctgcatcgtagctgct

SEQ ID NO: 284 - protein, 7 aa, Artificial Sequence
  Synthesized
QRASLTR

SEQ ID NO: 285 - DNA, 24 bp, Homo sapiens
agctgccccttcgcggacgtggcc

SEQ ID NO: 286 - protein, 7 aa, Artificial Sequence
  Synthesized
DRSNLTR

SEQ ID NO: 287 - protein, 7 aa, Artificial Sequence
  Synthesized
RSDALSR

SEQ ID NO: 288 - protein, 7 aa, Artificial Sequence
  Synthesized
ERGTLAR

SEQ ID NO: 289 - DNA, 24 bp, Homo sapiens
tgccgcccctactgtggagatgga

SEQ ID NO: 290 - protein, 7 aa, Artificial Sequence
  Synthesized
TSGNLVR

SEQ ID NO: 291 - protein, 7 aa, Artificial Sequence
  Synthesized
QSGHLAR

SEQ ID NO: 292 - protein, 7 aa, Artificial Sequence
  Synthesized
RSDDLQR

SEQ ID NO: 293 - DNA, 24 bp, Homo sapiens
accatcaacagactggaagtgggg

SEQ ID NO: 294 - protein, 7 aa, Artificial Sequence
  Synthesized
QTVNLDR

SEQ ID NO: 295 - protein, 7 aa, Artificial Sequence
  Synthesized
KKDHLHR

SEQ ID NO: 296 - DNA, 24 bp, Homo sapiens
agctgccccttcgcggacgtggcc

SEQ ID NO: 297 - protein, 7 aa, Artificial Sequence
  Synthesized
HHNSLTR

SEQ ID NO: 298 - protein, 7 aa, Artificial Sequence
  Synthesized
MKHHLDA

SEQ ID NO: 299 - protein, 7 aa, Artificial Sequence
  Synthesized
DPSNLRR

SEQ ID NO: 300 - protein, 7 aa, Artificial Sequence
  Synthesized
RREVLEN

SEQ ID NO: 301 - protein, 7 aa, Artificial Sequence
  Synthesized
QSGSLTR

SEQ ID NO: 302 - protein, 7 aa, Artificial Sequence
  Synthesized
DRSDLTR

SEQ ID NO: 303 - protein, 7 aa, Artificial Sequence
  Synthesized
QSSALTR

SEQ ID NO: 304 - DNA, 24 bp, Homo sapiens
tgcggcaacctacatgatggggaa

SEQ ID NO: 305 - protein, 7 aa, Artificial Sequence
  Synthesized
QRSNLVR

SEQ ID NO: 306 - protein, 7 aa, Artificial Sequence
  Synthesized
RSDHLTR

SEQ ID NO: 307 - protein, 7 aa, Artificial Sequence
  Synthesized
TSANLSR

SEQ ID NO: 308 - protein, 7 aa, Artificial Sequence
  Synthesized
QSSDLTR

SEQ ID NO: 309 - protein, 7 aa, Artificial Sequence
  Synthesized
RSDNLAR

SEQ ID NO: 310 - protein, 7 aa, Artificial Sequence
  Synthesized
QSGHLQR

SEQ ID NO: 311 - DNA, 23 bp, Homo sapiens
agcctctccagccaggggctgag

SEQ ID NO: 312 - protein, 7 aa, Artificial Sequence
  Synthesized
RSDHLSR

SEQ ID NO: 313 - protein, 7 aa, Artificial Sequence
  Synthesized
RSDHLAR

SEQ ID NO: 314 - protein, 7 aa, Artificial Sequence
  Synthesized
QSGDLTR

SEQ ID NO: 315 - protein, 7 aa, Artificial Sequence
  Synthesized
RSDDLTR

SEQ ID NO: 316 - protein, 7 aa, Artificial Sequence
  Synthesized
RSDALTR

SEQ ID NO: 317 - protein, 7 aa, Artificial Sequence
  Synthesized
TSGHLVR

SEQ ID NO: 318 - protein, 7 aa, Artificial Sequence
  Synthesized
QSSDLQR

SEQ ID NO: 319 - DNA, 24 bp, Artificial Sequence
  Synthesized
ccctgccgcctgcctgctggtgtg

SEQ ID NO: 320 - protein, 7 aa, Artificial Sequence
  Synthesized
GGTALRM

SEQ ID NO: 321 - protein, 7 aa, Artificial Sequence
  Synthesized
QRSSLVR

SEQ ID NO: 322 - protein, 7 aa, Artificial Sequence
  Synthesized
QRNNLGR

SEQ ID NO: 323 - protein, 7 aa, Artificial Sequence
  Synthesized
RKRNLIM

SEQ ID NO: 324 - protein, 7 aa, Artificial Sequence
  Synthesized
VRHNLTR

SEQ ID NO: 325 - protein, 7 aa, Artificial Sequence
  Synthesized
RGDKLGP

SEQ ID NO: 326 - DNA, 24 bp, Homo sapiens
gtttacttcctttggggggattgc

SEQ ID NO: 327 - protein, 7 aa, Artificial Sequence
  Synthesized
SRFTLGR

SEQ ID NO: 328 - protein, 7 aa, Artificial Sequence
  Synthesized
RREHLVR

SEQ ID NO: 329 - protein, 7 aa, Artificial Sequence
  Synthesized
QTATLKR

SEQ ID NO: 330 - protein, 7 aa, Artificial sequence
  Synthesized
KHSNLAR

SEQ ID NO: 331 - protein, 7 aa, Artificial Sequence
  Synthesized
QSTTLKR

SEQ ID NO: 332 - protein, 7 aa, Artificial Sequence
  Synthesized
RADGLQL

SEQ ID NO: 333 - DNA, 24 bp, Artificial Sequence
  Synthesized
cacccctgcaccgactcggcagag

SEQ ID NO: 334 - protein, 7 aa, Artificial Sequence
  Synthesized
TRQKLET

SEQ ID NO: 335 - protein, 7 aa, Artificial Sequence
  Synthesized
RQDNLGR

SEQ ID NO: 336 - protein, 7 aa, Artificial Sequence
  Synthesized
QQHGLRH

SEQ ID NO: 337 - protein, 7 aa, Artificial Sequence
  Synthesized
TKKILTV

SEQ ID NO: 338 - protein, 7 aa, Artificial Sequence
  Synthesized
HKSSLTR

SEQ ID NO: 339 - protein, 7 aa, Artificial Sequence
  Synthesized
RSDHLSL

SEQ ID NO: 340 - DNA, 23 bp, Homo sapiens
accctcacaacctttgggttgtc

SEQ ID NO: 341 - protein, 7 aa, Artificial Sequence
  Synthesized
RKHHLGR

SEQ ID NO: 342 - protein, 7 aa, Artificial Sequence
  Synthesized
VSNSLAR

SEQ ID NO: 343 - protein, 7 aa, Artificial Sequence
  Synthesized
RTSSLKR

SEQ ID NO: 344 - protein, 7 aa, Artificial Sequence
  Synthesized
QRSDLTR

SEQ ID NO: 345 - protein, 7 aa, Artificial Sequence
  Synthesized
RSDGLRG

SEQ ID NO: 346 - DNA, 24 bp, Homo sapiens
ccccccagcaccctttcggctgtg

SEQ ID NO: 347 - protein, 7 aa, Artificial Sequence
  Synthesized
DSPTLRR

SEQ ID NO: 348 - protein, 7 aa, Artificial Sequence
  Synthesized
QSAHLKR

SEQ ID NO: 349 - protein, 7 aa, Artificial Sequence
  Synthesized
QDVSLVR

SEQ ID NO: 350 - protein, 7 aa, Artificial Sequence
  Synthesized
MKNTLTR

SEQ ID NO: 351 - protein, 7 aa, Artificial Sequence
  Synthesized
QSGTLTR

SEQ ID NO: 352 - DNA, 24 bp, Homo sapiens
ggctcctgctgcatcgtagctgct

SEQ ID NO: 353 - protein, 7 aa, Artificial Sequence
  Synthesized
TKQILGR

SEQ ID NO: 354 - protein, 7 aa, Artificial Sequence
  synthesized
RTEHLAR

SEQ ID NO: 355 - protein, 7 aa, Artificial Sequence
  Synthesized
KRRDLDR

SEQ ID NO: 356 - protein, 245 aa, Artificial Sequence
  Synthesized
QLTQSPSSVSASVGDRVTITCRASRGISSWLAWYQQKPGKAPKLLIYTASSLQSGVPSRFSGSGSGTDFTLTISSLQPEDFATYYCQQAYSFPRTFGQGTKVEIKGGGGSGGGGSGGGGSQVQLQESGPGLVKPSQTLSLTCTVSGGSISSGGYYWIWIRQHPGKGLEWIGYIYYNGNTYYNPSLKSRVTMSVDTSKNQFSLKLSSVTAADTAVYYCARDGITMIRGYYYGMDVWGQGTTVTVSS

SEQ ID NO: 357 - protein, 7 aa, Artificial Sequence
  Synthesized
RTSSLKR

SEQ ID NO: 358 - protein, 7 aa, Artificial Sequence
  Synthesized
QRSDLTR

SEQ ID NO: 359 - protein, 7 aa, Artificial Sequence
  Synthesized
RSDHLSL

SEQ ID NO: 360 - DNA, 25 bp, Homo sapiens
cacagcccaagatagttaagtgggg

SEQ ID NO: 361 - protein, 7 aa, Artificial Sequence
  Synthesized
KKDHLHR

SEQ ID NO: 362 - protein, 7 aa, Artificial Sequence
  Synthesized
RREVLEN

SEQ ID NO: 363 - protein, 7 aa, Artificial Sequence
  Synthesized
QRGNLNM

SEQ ID NO: 364 - protein, 7 aa, Artificial Sequence
  Synthesized
VPSKLKR

SEQ ID NO: 365 - protein, 7 aa, Artificial Sequence
  Synthesized
EAHHLSR

SEQ ID NO: 366 - protein, 7 aa, Artificial Sequence
  Synthesized
QDGNLTR

SEQ ID NO: 367 - protein, 7 aa, Artificial Sequence
  Synthesized
TSTLLNR

SEQ ID NO: 368 - protein, 7 aa, Artificial Sequence
  Synthesized
QQTNLTR

SEQ ID NO: 369 - protein, 7 aa, Artificial Sequence
  Synthesized
VGNSLTR

SEQ ID NO: 370 - protein, 7 aa, Artificial Sequence
  Synthesized
QSGSLTR

SEQ ID NO: 371 - protein, 7 aa, Artificial Sequence
  Synthesized
TSGNLVR

SEQ ID NO: 372 - protein, 7 aa, Artificial Sequence
  Synthesized
QSGDLTR

SEQ ID NO: 373 - protein, 7 aa, Artificial Sequence
  Synthesized
RSDNLAR

SEQ ID NO: 374 - protein, 7 aa, Artificial Sequence
  Synthesized
DRSDLTR

SEQ ID NO: 375 - protein, 7 aa, Artificial Sequence
  Synthesized
QSGHLQR

SEQ ID NO: 376 - protein, 7 aa, Artificial Sequence
  Synthesized
DRSHLTR

SEQ ID NO: 377 - protein, 7 aa, Artificial Sequence
  Synthesized
RSDALSR

SEQ ID NO: 378 - protein, 7 aa, Artificial Sequence
  Synthesized
QSSDLQR

SEQ ID NO: 379 - protein, 7 aa, Artificial Sequence
  Synthesized
ERGTLAR

SEQ ID NO: 380 - protein, 7 aa, Artificial Sequence
  Synthesized
RSDDLQR

SEQ ID NO: 381 - protein, 7 aa, Artificial Sequence
  Synthesized
RSDALTR

SEQ ID NO: 382 - protein, 7 aa, Artificial Sequence
  Synthesized
RSDHLAR

SEQ ID NO: 383 - protein, 7 aa, Artificial Sequence
  Synthesized
QSGDLTR

SEQ ID NO: 384 - protein, 7 aa, Artificial Sequence
  Synthesized
QSGHLQR

SEQ ID NO: 385 - protein, 7 aa, Artificial Sequence
  Synthesized
QSSDLTR

SEQ ID NO: 386 - protein, 7 aa, Artificial Sequence
  Synthesized
QSSDLTR

SEQ ID NO: 387 - protein, 7 aa, Artificial Sequence
  Synthesized
RSDHLSR

SEQ ID NO: 388 - protein, 7 aa, Artificial Sequence
  Synthesized
QSGHLAR

SEQ ID NO: 389 - protein, 7 aa, Artificial Sequence
  Synthesized
DRSDLTR

SEQ ID NO: 390 - protein, 7 aa, Artificial Sequence
  Synthesized
QSGNLAR

SEQ ID NO: 391 - protein, 7 aa, Artificial Sequence
  Synthesized
DRSHLTR

SEQ ID NO: 392 - protein, 7 aa, Artificial Sequence
  Synthesized
QSGDLTR

SEQ ID NO: 393 - protein, 7 aa, Artificial Sequence
  Synthesized
QSGHLQR

SEQ ID NO: 394 - protein, 7 aa, Artificial Sequence
  Synthesized
RSHILTN

SEQ ID NO: 395 - protein, 7 aa, Artificial Sequence
  Synthesized
QSTTLKR

SEQ ID NO: 396 - protein, 7 aa, Artificial Sequence
  Synthesized
DGGHLTR

SEQ ID NO: 397 - protein, 7 aa, Artificial Sequence
  Synthesized
RQMNLDR

SEQ ID NO: 398 - protein, 7 aa, Artificial Sequence
  Synthesized
RQDNLGR

SEQ ID NO: 399 - protein, 7 aa, Artificial Sequence
  Synthesized
DKSVLAR

SEQ ID NO: 400 - DNA, 23 bp, Homo sapiens
gccaccttcccccagctgaagtc

SEQ ID NO: 401 - DNA, 24 bp, Homo sapiens
tgcatctgcgacgtgggagccgag

SEQ ID NO: 402 - DNA, 23 bp, Homo sapiens
gcccacagccactcgtggcggcc

SEQ ID NO: 403 - DNA, 23 bp, Homo sapiens
ccctgctccctccgggggctgct

SEQ ID NO: 404 - DNA, 23 bp, Homo sapiens
tccggcttctccatggagcaggc

SEQ ID NO: 405 - DNA, 24 bp, Homo sapiens
cactgcgcccacgaggccgaggag

SEQ ID NO: 406 - protein, 7 aa, Artificial Sequence
  Synthesized
HKWVLRQ

SEQ ID NO: 407 - protein, 7 aa, Artificial Sequence
  Synthesized
DRSNLTR

SEQ ID NO: 408 - DNA, 19 bp, Homo sapiens
gttgctccaggccacagca

SEQ ID NO: 409 - protein, 7 aa, Artificial Sequence
  Synthesized
QSGDLTR

SEQ ID NO: 410 - protein, 7 aa, Artificial Sequence
  Synthesized
QWGTRYR

SEQ ID NO: 411 - protein, 7 aa, Artificial Sequence
  Synthesized
ERGTLAR

SEQ ID NO: 412 - protein, 7 aa, Artificial Sequence
  Synthesized
QSGDLTR

SEQ ID NO: 413 - protein, 7 aa, Artificial Sequence
  Synthesized
TSGALTR

SEQ ID NO: 414 - DNA, 12 bp, Homo sapiens
gactttgcatgt

SEQ ID NO: 415 - protein, 7 aa, Artificial Sequence
  Synthesized
WRSSLAS

SEQ ID NO: 416 - protein, 7 aa, Artificial Sequence
  Synthesized
QSGSLTR

SEQ ID NO: 417 - protein, 9 aa, Artificial Sequence
  Synthesized
TGPGAAARA

SEQ ID NO: 418 - protein, 5 aa, Artificial Sequence
  Synthesized
LRGSQ

SEQ ID NO: 419 - DNA, 18 bp, Homo sapiens
ctccagccaggtccatct

SEQ ID NO: 420 - DNA, 17 bp, Homo sapiens
tctccagccaggtccat

SEQ ID NO: 421 - DNA, 15 bp, Homo sapiens
tcagcaggctgttgt

SEQ ID NO: 422 - DNA, 17 bp, Homo sapiens
tcagcaggctgttgtgt

SEQ ID NO: 423 - DNA, 15 bp, Homo sapiens
ccctggtctcttcat

SEQ ID NO: 424 - DNA, 16 bp, Homo sapiens
aagcctccctggtctt

SEQ ID NO: 425 - DNA, 15 bp, Homo sapiens
aagcctccctggtct

SEQ ID NO: 426 - DNA, 17 bp, Homo sapiens
gctgaccccctgtgcct

SEQ ID NO: 427 - DNA, 16 bp, Homo sapiens
gaccccctgtgcctct

SEQ ID NO: 428 - protein, 21 aa, Artificial Sequence
  Synthesized
MALPVTALLLPLALLLHAARP

SEQ ID NO: 429 - protein, 113 aa, Artificial Sequence; identical to SEQ ID NO: 72
  Synthesized

SEQ ID NO: 430 - protein, 116 aa, Artificial Sequence; identical to SEQ ID NO: 71
  Synthesized

SEQ ID NO: 431 - protein, 20 aa, Artificial Sequence
  Synthesized
GGGGSGGGGSGGGGSGGGGS

SEQ ID NO: 432 - protein, 120 aa, Artificial Sequence
  Synthesized
EVQLVESGGGLVQPGGSLRLSCAASGVSLPDYGVSWVRQAPGKGLEWVSVIWGSETTYYNSALKSRFTISRDNAKNSLYLQMNSLRAEDTAVYYCAKHYYYGGSYAMDYWGQGTLVTVSS

SEQ ID NO: 433 - protein, 107 aa, Artificial Sequence; identical to SEQ ID NO: 74
  Synthesized

SEQ ID NO: 434 - protein, 240 aa, Artificial Sequence
  Synthesized
DIVMTQSHKFMSTSIGARVSITCKASQDVRTAVAWYQQKPGQSPKLLIYSASYRYTGVPDRFTGSGSGTDFTFTISSVQAEDLAVYYCQQHYGTPPWTFGGGTKLEIKGGGGSGGGGSGGGGSEVQLVESGGGLVKPGGSLKLSCEASRFTFSSYAMSWVRQTPEKRLEWVAAISGGGRYTYYPDSMKGRFTISRDNAKNFLYLQMSSLRSEDTAMYYCARHYDGYLDYWGQGTTLTVSS

SEQ ID NO: 435 - protein, 238 aa, Artificial Sequence
  Synthesized
DIVMTQSHKFMSTSIGARVSITCKASQDVRTAVAWYQQKPGQSPKWYSASYRYTGVPDRFTGSGSGTDFTFTISSVQAEDLAVYYCQQHYGTPPWTFGGGTKLEIKGGGGSGGGGSGGGGSEVQLVESGGGLVKPGGSLKLSCEASRFTFSSYAMSWVRQTPEKRLEWVAAISGGGRYTYYPDSMKGRFTISRDNAKNFLYLQMSSLRSEDTAMYYCARHYDGYLDYWGQGTTLTVSS

SEQ ID NO: 436 - protein, 244 aa, Artificial Sequence
  Synthesized
EVQLVESGGGLVQPGGSLRLSCAASGFTFSSFGMHWVRQAPGKGLEWVAYISSDSSAIYYADTVKGRFTISRDNAKNSLYLQMNSLRDEDTAVYYCGRGRENIYYGSRLDYWGQGTTVTVSSGGGGSGGGGSGGGGSDIQLTQSPSFLSASVGDRVTITCKASQNVDTNVAWYQQKPGKAPKALIYSASYRYSGVPSRFSGSGSGTDFTLTISSLQPEDFATYYCQQYNNYPFTFGQGTKLEIK

SEQ ID NO: 437 - protein, 113 aa, Artificial Sequence
  Synthesized
DIVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPFTFGSGTKLEIK

SEQ ID NO: 438 - protein, 118 aa, Artificial Sequence
  Synthesized
QVQLQQPGAELVRPGASVKLSCKASGYTFTSYWINWVKQRPGQGLEWIGNIYPSDSYTNYNQKFKDKATLTVDKSSSTAYMQLSSPTSEDSAVYYCTRSWRGNSFDYWGQGTTLTVSS

SEQ ID NO: 439 - protein, 267 aa, Artificial sequence
  Synthesized
MALPVTALLLPLALLLHAARPDIVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPFTFGSGTKLEIKGGGGSGGGGSGGGGSQVQLQQPGAELVRPGASVKLSCKASGYTFTSYWINWVKQRPGQGLEWIGNIYPSDSYTNYNQKFKDKATLTVDKSSSTAYMQLSSPTSEDSAVYYCTRSWRGNSFDYWGQGTTLTVSS

The invention claimed is:

1. A bispecific chimeric antigen receptor (CAR), comprising:
a first antigen binding domain, a second antigen binding domain, a cytoplasmic domain, and a transmembrane domain, wherein the first antigen binding domain comprises amino acid SEQ ID NO: 5, and the second antigen antigen binding domain binds GUCY2C.

2. The bispecific CAR of claim 1, wherein the cytoplasmic domain of the bispecific CAR comprises a co-stimulatory domain, and a CD3 zeta domain.

3. The bispecific CAR of claim 2, wherein the co-stimulatory domain comprises the intracellular domain of CD27, CD28, 4-1BB, OX40, CD30, CD40, PD-1, ICOS, lymphocyte function-associated antigen-1 (LFA-1), CD2, CD7, LIGHT, NKG2C, B7-H3, a ligand that binds CD83, or a combination thereof.

4. The bispecific CAR of claim 1, wherein the first antigen binding domain comprises the amino acid sequence of the SEQ ID NO: 5, and the second antigen binding domain comprises the amino acid sequence of the SEQ ID NO: 11.

5. A polynucleotide encoding the bispecific CAR of claim 1.

6. A vector comprising the polynucleotide of claim 5.

7. A cell comprising the polynucleotide of claim 5.

* * * * *